(12) United States Patent
Brown

(10) Patent No.: US 8,372,816 B2
(45) Date of Patent: Feb. 12, 2013

(54) METHODS AND COMPOSITIONS FOR THE SPECIFIC INHIBITION OF KRAS BY ASYMMETRIC DOUBLE-STRANDED RNA

(75) Inventor: Bob D. Brown, Millington, NJ (US)

(73) Assignee: Dicerna Pharmaceuticals, Inc., Watertown, MA (US)

( * ) Notice: Subject to any disclaimer, the term of this patent is extended or adjusted under 35 U.S.C. 154(b) by 0 days.

(21) Appl. No.: 12/754,427

(22) Filed: Apr. 5, 2010

(65) Prior Publication Data

US 2011/0021604 A1    Jan. 27, 2011

Related U.S. Application Data

(60) Provisional application No. 61/166,559, filed on Apr. 3, 2009, provisional application No. 61/166,578, filed on Apr. 3, 2009, provisional application No. 61/174,306, filed on Apr. 30, 2009, provisional application No. 61/174,279, filed on Apr. 30, 2009, provisional application No. 61/183,818, filed on Jun. 3, 2009, provisional application No. 61/183,815, filed on Jun. 3, 2009, provisional application No. 61/184,735, filed on Jun. 5, 2009, provisional application No. 61/257,820, filed on Nov. 3, 2009, provisional application No. 61/257,810, filed on Nov. 3, 2009, provisional application No. 61/285,925, filed on Dec. 11, 2009, provisional application No. 61/309,266, filed on Mar. 1, 2010.

(51) Int. Cl.
*C12Q 1/68* (2006.01)
*C07H 21/04* (2006.01)

(52) U.S. Cl. .................... 514/44 A; 536/24.5

(58) Field of Classification Search ............. 514/44 A; 536/24.5

See application file for complete search history.

(56) References Cited

U.S. PATENT DOCUMENTS

| | | | |
|---|---|---|---|
| 6,506,559 B1 * | 1/2003 | Fire et al. | 435/6.16 |
| 2002/0076696 A1 | 6/2002 | Kawaguchi et al. | |
| 2004/0121348 A1 * | 6/2004 | Kreutzer et al. | 435/6 |
| 2004/0175703 A1 * | 9/2004 | Kreutzer et al. | 435/6 |
| 2009/0043083 A1 | 2/2009 | Rossi et al. | |

FOREIGN PATENT DOCUMENTS

WO    WO-2007031091 A2    3/2007

OTHER PUBLICATIONS

International Search Report dated Sep. 2, 2010, for related application PCT/US 10/29992.
International Search Report dated Sep. 9, 2010 in related application PCT/US2010/029992.

\* cited by examiner

*Primary Examiner* — Brian Whiteman
(74) *Attorney, Agent, or Firm* — Edwards Wildman Palmer LLP; Kathleen Williams

(57) ABSTRACT

This invention relates to compounds, compositions, and methods useful for reducing KRAS target RNA and protein levels via use of Dicer substrate siRNA (DsiRNA) agents possessing asymmetric end structures.

57 Claims, 31 Drawing Sheets

Figure 1

Ago2 cleavage sites are all aligned

|  |  |  | SEQ ID NO: |
|---|---|---|---|
| DsiRNA 25/27mer | 5'-CAGGUCAAGAGGAGUACAGUGCAau-3'<br>3'-UCGUCCAGUUCCUCAUGUCACGUUA-5' | DP1148P<br>DP1151G | 5<br>14 |
| siRNA 21mer | 5'-CAGGUCAAGAGGAGUACAGUG-3'<br>3'-UCGUCCAGUUCCUCAUGUC-5' | DP1158P<br>DP1159G | 8538<br>8539 |
| DsiRNA 27/27 Blunt/Blunt | 5'-AGCAGGUCAAGAGGAGUACAGUGCAAU-3'<br>3'-UCGUCCAGUUCCUCAUGUCACGUUA-5' | DP1149P<br>DP1151G | 6<br>14 |
| siRNA 21mer Blunt-Blunt | 5'-AGCAGGUCAAGAGGAGUACAG-3'<br>3'-UCGUCCAGUUCCUCAUGUC-5' | DP1156P<br>DP1159G | 8540<br>8539 |
| DsiRNA 27/27 Blunt/Fray-R | 5'-AGCAGGUCAAGAGGAGUACAGUGCAUA-3'<br>3'-UCGUCCAGUUCCUCAUGUCACGUUA-5' | DP1150P<br>DP1151G | 7<br>14 |
| siRNA 21mer Blunt/Fray-R | 5'-AGCAGGUCAAGAGGAGUACUA-3'<br>3'-UCGUCCAGUUCCUCAUGUC-5' | DP1157P<br>DP1159G | 8542<br>8539 |

Figure 4

Ago2 cleavage sites are all aligned

| | | | SEQ ID NO: |
|---|---|---|---|
| DsiRNA 25/27mer | 5'-UUUAGCAUUUGUUUUAGCAUUACCta-3'<br>3'-AUAAUCGUAAACAAAAUCGUAAUGGAU-5' | DP1136P<br>DP1139G | 8<br>43 |
| siRNA 21mer | 5'-UUUAGCAUUUGUUUUAGCAUUA-3'<br>3'-AUAAUCGUAAACAAAAUCGUAAU-5' | DP1146P<br>DP1147G | 8543<br>8544 |
| DsiRNA 27/27 Blunt/Blunt | 5'-UAUUAGCAUUUGUUUUAGCAUUACCUA-3'<br>3'-AUAAUCGUAAACAAAAUCGUAAUGGAU-5' | DP1137P<br>DP1139G | 9<br>43 |
| siRNA 21mer Blunt-Blunt | 5'-UAUUAGCAUUUGUUUUAGCAU-3'<br>3'-AUAAUCGUAAACAAAAUCGUA-5' | DP1144P<br>DP1147G | 8545<br>8544 |
| DsiRNA 27/27 Blunt/Fray-R | 5'-UAUUAGCAUUUGUUUUAGCAUUACCC-3'<br>3'-AUAAUCGUAAACAAAAUCGUAAUGAU-5' | DP1138P<br>DP1139G | 8547<br>43 |
| siRNA 21mer Blunt/Fray-R | 5'-UAUUAGCAUUUGUUUUAGCCC-3'<br>3'-AUAAUCGUAAACAAAAUCGUA-5' | DP1145P<br>DP1147G | 8548<br>8544 |

Ago2 cleavage sites indicated by ▼.

METHODS AND COMPOSITIONS FOR THE SPECIFIC INHIBITION OF KRAS BY ASYMMETRIC DOUBLE-STRANDED RNA

CROSS-REFERENCE TO RELATED APPLICATIONS

The present application claims priority to, and the benefit under 35 U.S.C. §119(e) of, the following applications: U.S. provisional patent application No. 61/166,559, filed Apr. 3, 2009, now expired; U.S. provisional patent application No. 61/166,578, filed Apr. 3, 2009, now expired; U.S. provisional patent application No. 61/174,279, filed Apr. 30, 2009, now expired; U.S. provisional patent application No. 61/174,306, filed Apr. 30, 2009, now expired; U.S. provisional patent application No. 61/257,810, filed Nov. 3, 2009, now expired; and U.S. provisional patent application No. 61/257,820, filed Nov. 3, 2009, now expired. The present application also claims priority to the following applications: U.S. patent application Ser. No. 12/704,256, filed Feb. 11, 2010, published as US 2010-0249214 A1, now abandoned; U.S. patent application Ser. No. 12/642,371, filed Dec. 18, 2009, published as US 2010-0173974 A1; U.S. patent application Ser. No. 12/642,404, filed Dec. 18, 2009, published as US 2010-0202442 A1; U.S. patent application Ser. No. 12/642,264, filed Dec. 18, 2009, published as US 2010-0173973 A1, now abandoned; and PCT application No. PCT/US2009/005214, filed Sep. 17, 2009, published as WO 2010/033225. The present application claims priority to, and the benefit under 35 U.S.C. §119(e) of, the following applications: U.S. provisional patent application No. 61/183,815, filed Jun. 3, 2009, now expired; U.S. provisional patent application No. 61/183,818, filed Jun. 3, 2009, now expired; U.S. provisional patent application No. 61/184,735, filed Jun. 5, 2009, now expired; U.S. provisional patent application No. 61/285,925, filed Dec. 11, 2009, now expired; and U.S. provisional patent application No. 61/309,266, filed Mar. 1, 2010, now expired. The entire teachings of the above applications are incorporated herein by reference.

FIELD OF THE INVENTION

The present invention relates to compounds, compositions, and methods for the study, diagnosis, and treatment of traits, diseases and conditions that respond to the modulation of KRAS gene expression and/or activity. The present invention is also directed to compounds, compositions, and methods relating to traits, diseases and conditions that respond to the modulation of expression and/or activity of genes involved in KRAS gene expression pathways or other cellular processes that mediate the maintenance or development of such traits, diseases and conditions. Specifically, the invention relates to small nucleic acid molecules that are capable of being processed by the Dicer enzyme, such as Dicer substrate siRNAs (DsiRNAs) capable of mediating RNA interference (RNAi) against KRAS gene expression. Such anti-KRAS DsiRNAs are useful, for example, in providing compositions for treatment of traits, diseases and conditions that can respond to modulation of KRAS in a subject, such as cancer and/or other proliferative diseases, disorders, or conditions.

BACKGROUND OF THE INVENTION

Disregulated Ras signaling can lead to tumor growth and metastasis (Goodsell D S. Oncologist 4: 263-4). It is estimated that 20-25% of all human tumors contain activating mutations in Ras; and in specific tumor types, this figure can be as high as 90% (Downward J. Nat Rev Cancer, 3: 11-22). Accordingly, members of the Ras gene family are attractive molecular targets for cancer therapeutic design.

The three human RAS genes encode highly related 188 to 189 amino acid proteins, designated H-Ras, N-Ras and K-Ras4A (KRAS isoform a) and K-Ras4B (KRAS isoform b; the two KRas proteins arise from alternative gene splicing). Ras proteins function as binary molecular switches that control intracellular signaling networks. Ras-regulated signal pathways control such processes as actin cytoskeletal integrity, proliferation, differentiation, cell adhesion, apoptosis, and cell migration. Ras and Ras-related proteins are often deregulated in cancers, leading to increased invasion and metastasis, and decreased apoptosis. Ras activates a number of pathways but an especially important one for tumorigenesis appears to be the mitogen-activated protein (MAP) kinases, which themselves transmit signals downstream to other protein kinases and gene regulatory proteins (Lodish et al. *Molecular Cell Biology* (4th ed.). San Francisco: W.H. Freeman, Chapter 25, "Cancer").

Double-stranded RNA (dsRNA) agents possessing strand lengths of 25 to 35 nucleotides have been described as effective inhibitors of target gene expression in mammalian cells (Rossi et al., U.S. Patent Application Nos. 2005/0244858 and US 2005/0277610). dsRNA agents of such length are believed to be processed by the Dicer enzyme of the RNA interference (RNAi) pathway, leading such agents to be termed "Dicer substrate siRNA" ("DsiRNA") agents. Additional modified structures of DsiRNA agents were previously described (Rossi et al., U.S. Patent Application No. 2007/0265220).

BRIEF SUMMARY OF THE INVENTION

The present invention is directed to compositions that contain double stranded RNA ("dsRNA"), and methods for preparing them. The dsRNAs of the invention are capable of reducing the expression of a target KRas gene in a cell, either in vitro or in a mammalian subject. More particularly, the invention is directed to preferred Dicer substrate siRNAs ("DsiRNAs") with structures and modification patterns that are optimized to act as effective and highly potent KRAS inhibitory agents, optionally possessing extended duration of inhibitory effect. A majority of such DsiRNAs possess target-specific inhibitory potencies and efficacies that are surprisingly enhanced relative to 21 nucleotide siRNAs directed against the same target RNA. While not intending to be bound by theory, such enhanced activity likely reflects an advantage inherent in DsiRNA agents engaging the RNAi pathway at a point in the pathway that is upstream of the point at which shorter siRNA agents engage the RNAi pathway.

In one aspect, the invention provides an isolated double stranded ribonucleic acid (dsRNA) comprising first and second nucleic acid strands and a duplex region of at least 25 base pairs, wherein the second strand of said dsRNA comprises 1-5 single-stranded nucleotides at its 3' terminus, wherein the second oligonucleotide strand is sufficiently complementary to a target KRAS cDNA sequence selected from the group consisting of SEQ ID NOs: 141-186 along at least 19 nucleotides and at most 35 nucleotides of the second oligonucleotide strand length to reduce KRAS target gene expression when the double stranded nucleic acid is introduced into a mammalian cell.

In one embodiment, starting from the first nucleotide (position 1) at the 3' terminus of the first oligonucleotide strand, position 1, 2 and/or 3 is substituted with a modified nucleotide. In certain embodiments, the modified nucleotide residue of the 3' terminus of the first strand is a deoxyribonucleotide, an acyclonucleotide or a fluorescent molecule. In a related embodiment, position 1 of the 3' terminus of the first oligonucleotide strand is a deoxyribonucleotide.

In an additional embodiment, the 3' terminus of the first strand and the 5' terminus of the second strand form a blunt end.

In another embodiment, the first strand is 25 nucleotides in length and the second strand is 27 nucleotides in length.

In one embodiment, the second strand includes a sequence of SEQ ID NOs: 11-50 and 135-140.

In another embodiment, the first strand includes a sequence of SEQ ID NOs: 5, 8 and 91-134.

In an additional embodiment, the dsRNA includes a pair of first strand/second strand sequences that is SEQ ID NO: 5/SEQ ID NO: 14, SEQ ID NO: 8/SEQ ID NO: 43, SEQ ID NO: 132/SEQ ID NO: 138, SEQ ID NO: 91/SEQ ID NO: 11, SEQ ID NO: 129/SEQ ID NO: 135, SEQ ID NO: 92/SEQ ID NO: 12, SEQ ID NO: 130/SEQ ID NO: 136, SEQ ID NO: 93/SEQ ID NO: 13, SEQ ID NO: 131/SEQ ID NO: 137, SEQ ID NO: 94/SEQ ID NO: 15, SEQ ID NO: 133/SEQ ID NO: 139, SEQ ID NO: 95/SEQ ID NO: 16, SEQ ID NO: 96/SEQ ID NO: 17, SEQ ID NO: 97/SEQ ID NO: 18, SEQ ID NO: 98/SEQ ID NO: 19, SEQ ID NO: 99/SEQ ID NO: 20, SEQ ID NO: 100/SEQ ID NO: 21, SEQ ID NO: 101/SEQ ID NO: 22, SEQ ID NO: 102/SEQ ID NO: 23, SEQ ID NO: 103/SEQ ID NO: 24, SEQ ID NO: 104/SEQ ID NO: 25, SEQ ID NO: 105/SEQ ID NO: 26, SEQ ID NO: 106/SEQ ID NO: 27, SEQ ID NO: 107/SEQ ID NO: 28, SEQ ID NO: 108/SEQ ID NO: 29, SEQ ID NO: 109/SEQ ID NO: 30, SEQ ID NO: 110/SEQ ID NO: 31, SEQ ID NO: 111/SEQ ID NO: 32, SEQ ID NO: 112/SEQ ID NO: 33, SEQ ID NO: 113/SEQ ID NO: 34, SEQ ID NO: 114/SEQ ID NO: 35, SEQ ID NO: 115/SEQ ID NO: 36, SEQ ID NO: 116/SEQ ID NO: 37, SEQ ID NO: 117/SEQ ID NO: 38, SEQ ID NO: 118/SEQ ID NO: 39, SEQ ID NO: 119/SEQ ID NO: 40, SEQ ID NO: 134/SEQ ID NO: 140, SEQ ID NO: 120/SEQ ID NO: 41, SEQ ID NO: 121/SEQ ID NO: 42, SEQ ID NO: 122/SEQ ID NO: 44, SEQ ID NO: 123/SEQ ID NO: 45, SEQ ID NO: 124/SEQ ID NO: 46, SEQ ID NO: 125/SEQ ID NO: 47, SEQ ID NO: 126/SEQ ID NO: 48, SEQ ID NO: 127/SEQ ID NO: 49 or SEQ ID NO: 128/SEQ ID NO: 50.

In one embodiment, each of the first and the second strands has a length which is at least 26 nucleotides.

In another embodiment, the nucleotides of the 3' overhang include a modified nucleotide. Optionally, the modified nucleotide of the 3' overhang is a 2'-O-methyl ribonucleotide. In a related embodiment, all nucleotides of the 3' overhang are modified nucleotides.

In an additional embodiment, one or both of the first and second oligonucleotide strands includes a 5' phosphate.

In another embodiment, the modified nucleotide residues of the dsRNA are 2'-O-methyl, 2'-methoxyethoxy, 2'-fluoro, 2'-allyl, 2'-O-[2-(methylamino)-2-oxoethyl], 4'-thio, 4'-CH2-O-2'-bridge, 4'-(CH2)2-O-2'-bridge, 2'-LNA, 2'-amino or 2'-O—(N-methlycarbamate).

In one embodiment, the 3' overhang of the dsRNA is 1-3 nucleotides in length. Optionally, the 3' overhang is 1-2 nucleotides in length. In a related embodiment, the 3' overhang is two nucleotides in length and the modified nucleotide of the 3' overhang is a 2'-O-methyl modified ribonucleotide.

In a further embodiment, the second oligonucleotide strand, starting from the nucleotide residue of the second strand that is complementary to the 5' terminal nucleotide residue of the first oligonucleotide strand, includes alternating modified and unmodified nucleotide residues. In another embodiment, the second oligonucleotide strand, starting from the nucleotide residue of the second strand that is complementary to the 5' terminal nucleotide residue of the first oligonucleotide strand, includes unmodified nucleotide residues at all positions from position 18 to the 5' terminus of the second oligonucleotide strand.

In another embodiment, each of the first and the second strands has a length which is at least 26 and at most 30 nucleotides.

In one embodiment, the dsRNA is cleaved endogenously in the cell by Dicer.

In an additional embodiment, the amount of the isolated double stranded nucleic acid sufficient to reduce expression of the target gene is 1 nanomolar or less, 200 picomolar or less, 100 picomolar or less, 50 picomolar or less, 20 picomolar or less, 10 picomolar or less, 5 picomolar or less, 2 picomolar or less or 1 picomolar or less in the environment of the cell.

In a further embodiment, the isolated dsRNA possesses greater potency than isolated 21mer siRNAs directed to the identical at least 19 nucleotides of the target KRAS cDNA in reducing target KRAS gene expression when assayed in vitro in a mammalian cell at an effective concentration in the environment of a cell of 1 nanomolar or less, 200 picomolar or less, 100 picomolar or less, 50 picomolar or less, 20 picomolar or less, 10 picomolar or less, 5 picomolar or less, 2 picomolar or less or 1 picomolar or less.

In another embodiment, the isolated dsRNA is sufficiently complementary to the target KRAS cDNA sequence to reduce KRAS target gene expression by at least 10%, at least 50%, at least 80-90%, at least 95%, at least 98%, or at least 99% when the double stranded nucleic acid is introduced into a mammalian cell.

In a further embodiment, the first and second strands are joined by a chemical linker. In a related embodiment, the 3' terminus of the first strand and the 5' terminus of the second strand are joined by a chemical linker.

In one embodiment, a nucleotide of the second or first strand is substituted with a modified nucleotide that directs the orientation of Dicer cleavage.

In another embodiment, the dsRNA has a modified nucleotide that is a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (3TC), a 2',3'-didehydro-2',3'-dideoxythymidine (d4T), a monophosphate nucleotide of 3'-azido-3'-deoxythymidine (AZT), a 2',3'-dideoxy-3'-thiacytidine (3TC) and a monophosphate nucleotide of 2',3'-didehydro-2',3'-dideoxythymidine (d4T), a 4-thiouracil, a 5-bromouracil, a 5-iodouracil, a 5-(3-aminoallyl)-uracil, a 2'-O-alkyl ribonucleotide, a 2'-O-methyl ribonucleotide, a 2'-amino ribonucleotide, a 2'-fluoro ribonucleotide, or a locked nucleic acid.

In an additional embodiment, the dsRNA has a phosphonate, a phosphorothioate or a phosphotriesterphosphate backbone modification.

In one embodiment, the invention provides a method for reducing expression of a target KRAS gene in a mammalian cell having contacting a mammalian cell in vitro with an isolated dsRNA as described in an amount sufficient to reduce expression of a target KRAS gene in the cell.

In one embodiment, target KRAS gene expression is reduced by at least 10%, at least 50%, or at least 80-90%. In another embodiment, target KRAS mRNA levels are reduced at least 90% at least 8 days after the cell is contacted with the dsRNA. In a further embodiment, KRAS mRNA levels are reduced by at least 70% at least 10 days after the cell is contacted with the dsRNA.

In a further embodiment, the invention provides a method for reducing expression of a target KRAS gene in a mammal by administering an isolated dsRNA as described to a mammal in an amount sufficient to reduce expression of a target KRAS gene in the mammal.

In one embodiment, the isolated dsRNA is administered at a dosage of 1 microgram to 5 milligrams per kilogram of the mammal per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, or 0.1 to 2.5 micrograms per kilogram.

In another embodiment, the isolated dsRNA possesses greater potency than isolated 21 mer siRNAs directed to the identical at least 19 nucleotides of the target KRAS cDNA in reducing target KRAS gene expression when assayed in vitro in a mammalian cell at an effective concentration in the environment of a cell of 1 nanomolar or less.

In an additional embodiment, the administering step includes intravenous injection, intramuscular injection, intraperitoneal injection, infusion, subcutaneous injection, transdermal, aerosol, rectal, vaginal, topical, oral or inhaled delivery.

In a further embodiment, the invention provides a method for selectively inhibiting the growth of a cell by contacting a cell with an amount of an isolated dsRNA as described, in an amount sufficient to inhibit the growth of the cell.

In one embodiment, the cell is a tumor cell of a subject. Optionally, the cell is a tumor cell in vitro. In a related embodiment, the cell is a human cell.

In an additional embodiment, the invention provides a formulation which includes an isolated dsRNA as described, where the dsRNA is present in an amount effective to reduce target KRAS RNA levels when the dsRNA is introduced into a mammalian cell in vitro by at least 10%, at least 50% or at least 80-90%, and where the dsRNA possesses greater potency than isolated 21mer siRNAs directed to the identical at least 19 nucleotides of the target KRAS cDNA in reducing target KRAS RNA levels when assayed in vitro in a mammalian cell at an effective concentration in the environment of a cell of 1 nanomolar or less.

In one embodiment, the effective amount is 1 nanomolar or less, 200 picomolar or less, 100 picomolar or less, 50 picomolar or less, 20 picomolar or less, 10 picomolar or less, 5 picomolar or less, 2 picomolar or less or 1 picomolar or less in the environment of the cell.

In another embodiment, the invention provides a formulation which includes an isolated dsRNA as described, where the dsRNA is present in an amount effective to reduce target RNA levels when the dsRNA is introduced into a cell of a mammalian subject by at least 10%, at least 50% or at least 80-90%, and where the dsRNA possesses greater potency than isolated 21mer siRNAs directed to the identical at least 19 nucleotides of the target KRAS cDNA in reducing target KRAS RNA levels when assayed in vitro in a mammalian cell at an effective concentration in the environment of a cell of 1 nanomolar or less.

In one embodiment, the effective amount is a dosage of 1 microgram to 5 milligrams per kilogram of the subject per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, or 0.1 to 2.5 micrograms per kilogram.

In an additional embodiment, the invention provides a mammalian cell containing an isolated dsRNA as described.

Another embodiment of the invention provides a pharmaceutical composition which includes an isolated dsRNA as described and a pharmaceutically acceptable carrier. A further embodiment of the invention provides a kit having an isolated dsRNA as described and instructions for its use.

In an additional aspect, the invention provides a composition possessing KRAS inhibitory activity consisting essentially of an isolated double stranded ribonucleic acid (dsRNA) comprising first and second nucleic acid strands and a duplex region of at least 25 base pairs, wherein the second strand of said dsRNA comprises 1-5 single-stranded nucleotides at its 3' terminus, wherein the second oligonucleotide strand is sufficiently complementary to a target KRAS cDNA sequence selected from the group consisting of SEQ ID NOs: 141-186 along at least 19 nucleotides and at most 35 nucleotides of the second oligonucleotide strand length to reduce KRAS target gene expression when the double stranded nucleic acid is introduced into a mammalian cell.

In another aspect, the invention provides an isolated double stranded ribonucleic acid (dsRNA) comprising first and second nucleic acid strands and a duplex region of at least 25 base pairs, wherein the second strand of said dsRNA comprises 1-5 single-stranded nucleotides at its 3' terminus, wherein the second oligonucleotide strand is sufficiently complementary to a target KRAS cDNA sequence selected from the group consisting of SEQ ID NOs: 1595-2297 and 3704-4406 along at least 19 nucleotides and at most 35 nucleotides of the second oligonucleotide strand length to reduce KRAS target gene expression when the double stranded nucleic acid is introduced into a mammalian cell.

In one embodiment, the second strand includes a sequence of SEQ ID NOs: 189-891 and 2298-3000.

In another embodiment, the first strand includes a sequence of SEQ ID NOs: 892-1594 and 3001-3703.

In an additional embodiment, the dsRNA includes a DsiRNA agent selected from the group consisting of DsiRNA agents shown in Tables 4-5.

In a further aspect, the invention provides a composition possessing KRAS inhibitory activity consisting essentially of an isolated double stranded ribonucleic acid (dsRNA) comprising first and second nucleic acid strands and a duplex region of at least 25 base pairs, wherein the second strand of the dsRNA comprises 1-5 single-stranded nucleotides at its 3' terminus, wherein the second oligonucleotide strand is sufficiently complementary to a target KRAS cDNA sequence selected from the group consisting of SEQ ID NOs: 1595-2297 and 3704-4406 along at least 19 nucleotides and at most 35 nucleotides of the second oligonucleotide strand length to reduce KRAS target gene expression when the double stranded nucleic acid is introduced into a mammalian cell.

BRIEF DESCRIPTION OF THE DRAWINGS

FIG. 1 shows the structures of exemplary DsiRNA agents targeting a site in the KRAS RNA referred to herein as the "KRAS-355" target site. The 25/27mer and 27/27mer DsiRNA agents (optionally, possessing a blunt/fray design) were tested for KRas inhibitory efficacy in comparison with the 21mer siRNA constructs shown. UPPER case=unmodified RNA, lower case=DNA, Bold=mismatch base pair nucleotides; arrowheads indicate projected Dicer enzyme cleavage sites; dashed line indicates sense strand (top strand) sequences corresponding to the projected Argonaute 2 (Ago2) cleavage site within the targeted KRas sequence.

27mer DsiRNA and 21mer siRNA of FIG. 1; Blunt/Blunt and Blunt/Fray agents are as indicated in FIG. 1; "Veh"=vehicle-treated control; "Un"=untreated control.

Figure 3:
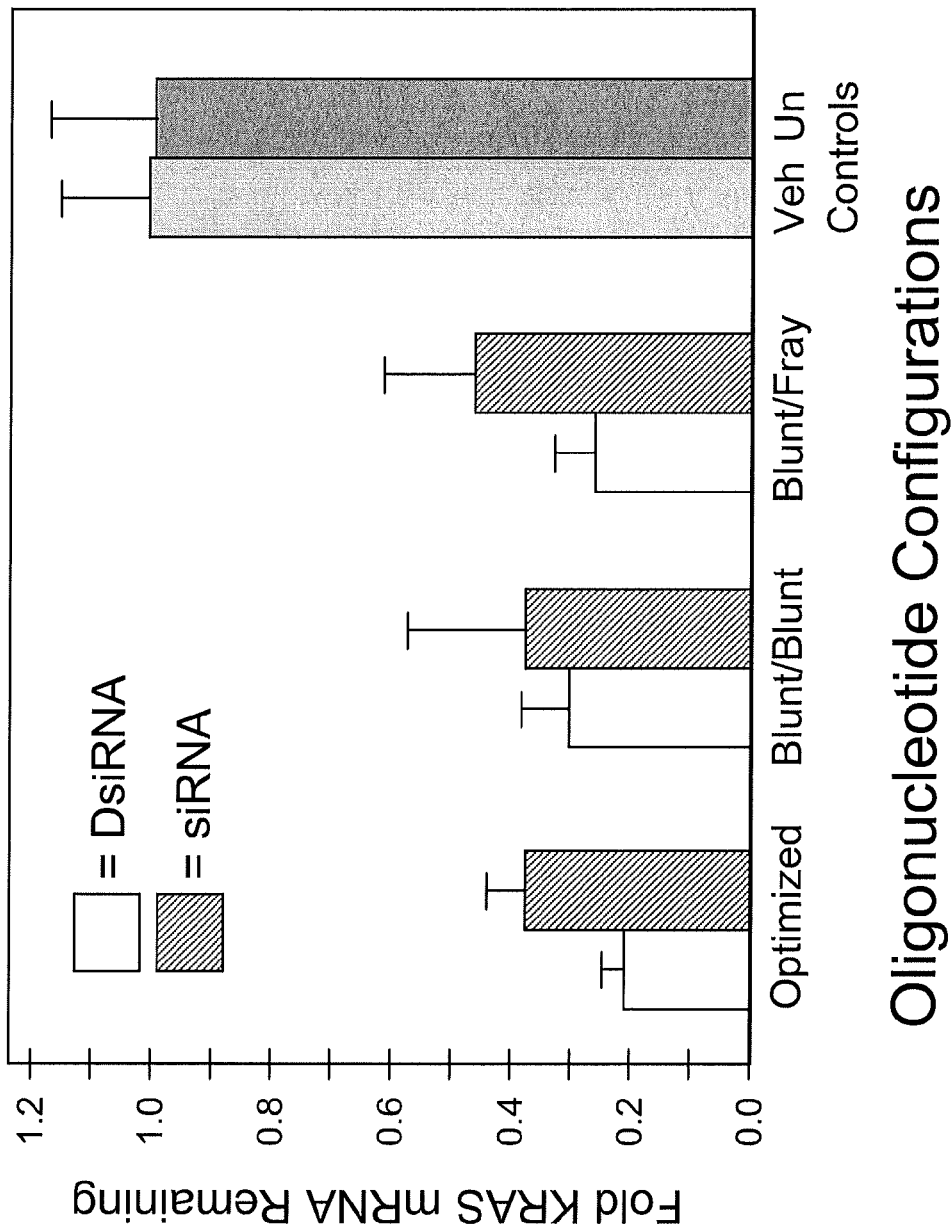

FIG. 3 shows the anti-KRAS inhibitory efficacy of the agents depicted in FIG. 1, when transformed into cells in culture at 100 picomolar concentration. "Optimized"=25/27mer DsiRNA and 21mer siRNA of FIG. 1; Blunt/Blunt and Blunt/Fray agents are as indicated in FIG. 1; "Veh"=vehicle-treated control; "Un"=untreated control.

FIG. 4 shows the structures of exemplary DsiRNA agents targeting a site in the KRAS RNA referred to herein as the "KRAS-940" target site. The 25/27mer and 27/27mer DsiRNA agents (optionally, possessing a blunt/fray design) were tested for KRAS inhibitory efficacy in comparison with the 21mer siRNA constructs shown. UPPER case=unmodified RNA, lower case=DNA, Bold=mismatch base pair nucleotides; arrowheads indicate projected Dicer enzyme cleavage sites; dashed line indicates sense strand (top strand) sequences corresponding to the projected Argonaute 2 (Ago2) cleavage site within the targeted KRAS sequence.

Figure 5:
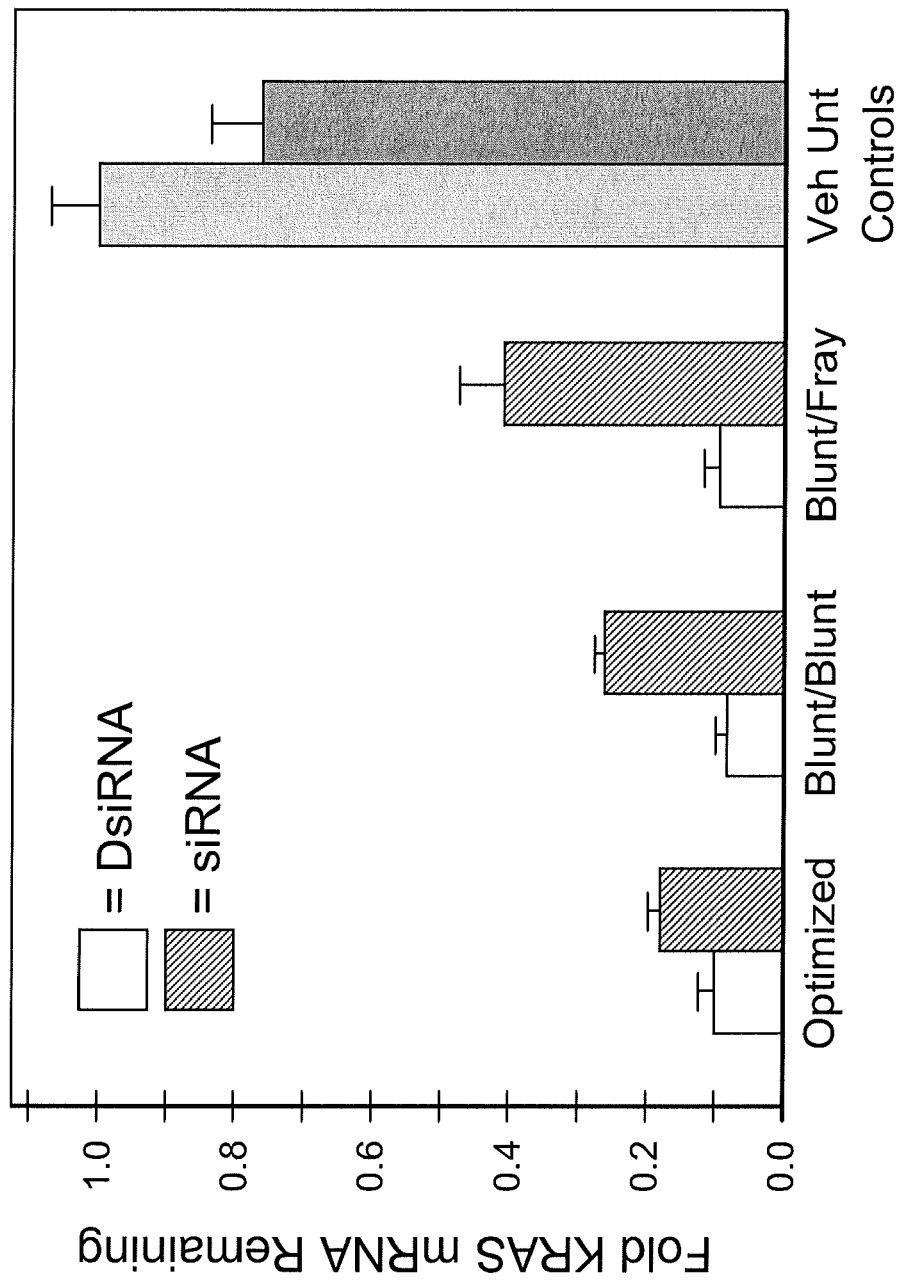

FIG. 5 shows the anti-KRAS inhibitory efficacy of the agents depicted in FIG. 4, when transformed into cells in culture at 1 nanomolar concentration. "Optimized"=25/27mer DsiRNA and 21mer siRNA of FIG. 4; Blunt/Blunt and Blunt/Fray agents are as indicated in FIG. 4; "Veh"=vehicle-treated control; "Un"=untreated control.

Figure 6:
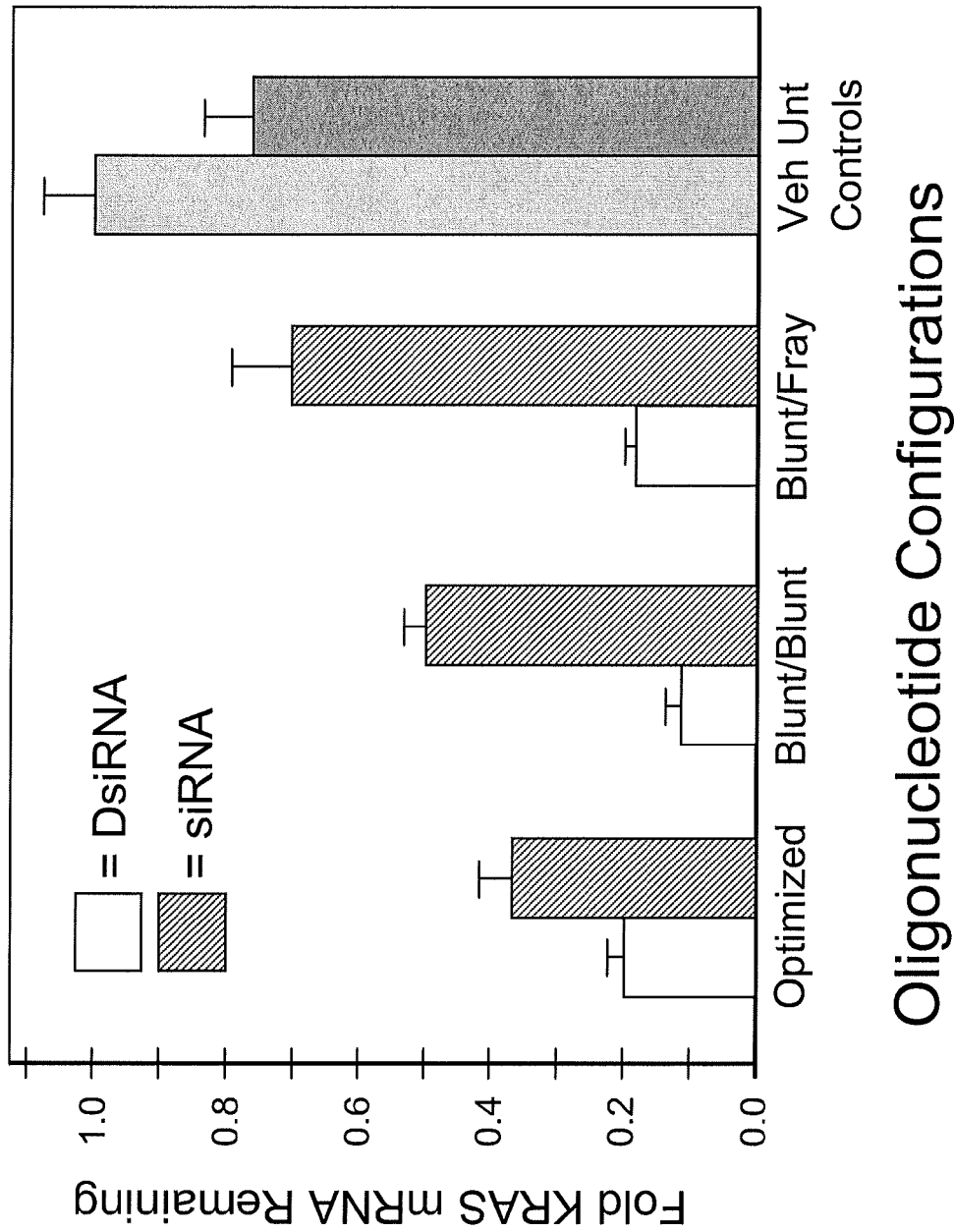

FIG. 6 shows the anti-KRAS inhibitory efficacy of the agents depicted in FIG. 4, when transformed into cells in culture at 100 picomolar concentration. "Optimized"=25/27mer DsiRNA and 21mer siRNA of FIG. 4; Blunt/Blunt and Blunt/Fray agents are as indicated in FIG. 4; "Veh"=vehicle-treated control; "Un"=untreated control.

Figure 7:
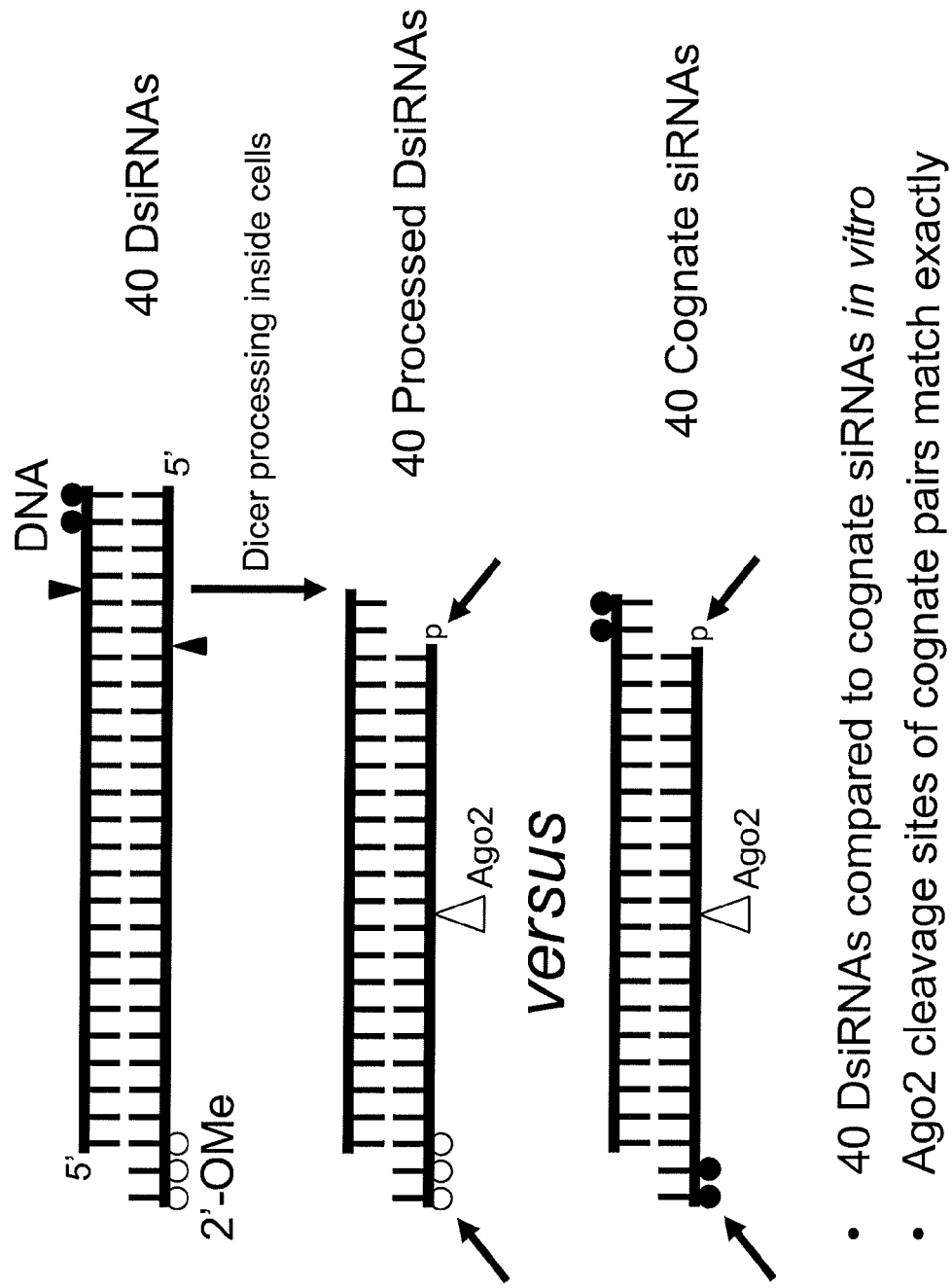

FIG. 7 shows a schematic comparison of tested DsiRNAs and their Dicer processing products, as compared to cognate 21 mer siRNAs directed against the same exact KRAS target sequence. 2'-O-methyl modifications are indicated by open circles; shaded circles indicate deoxyribonucleotides; shaded triangles indicate Dicer enzyme cleavage sites within a 25/27mer agent; open triangles indicate the position on the antisense strand corresponding to the Argonaute 2 (Ago2) cleavage sites within the target RNA. Such sites are identical between the 40 tested DsiRNA agents when compared to their cognate siRNA agents.

Figure 8:
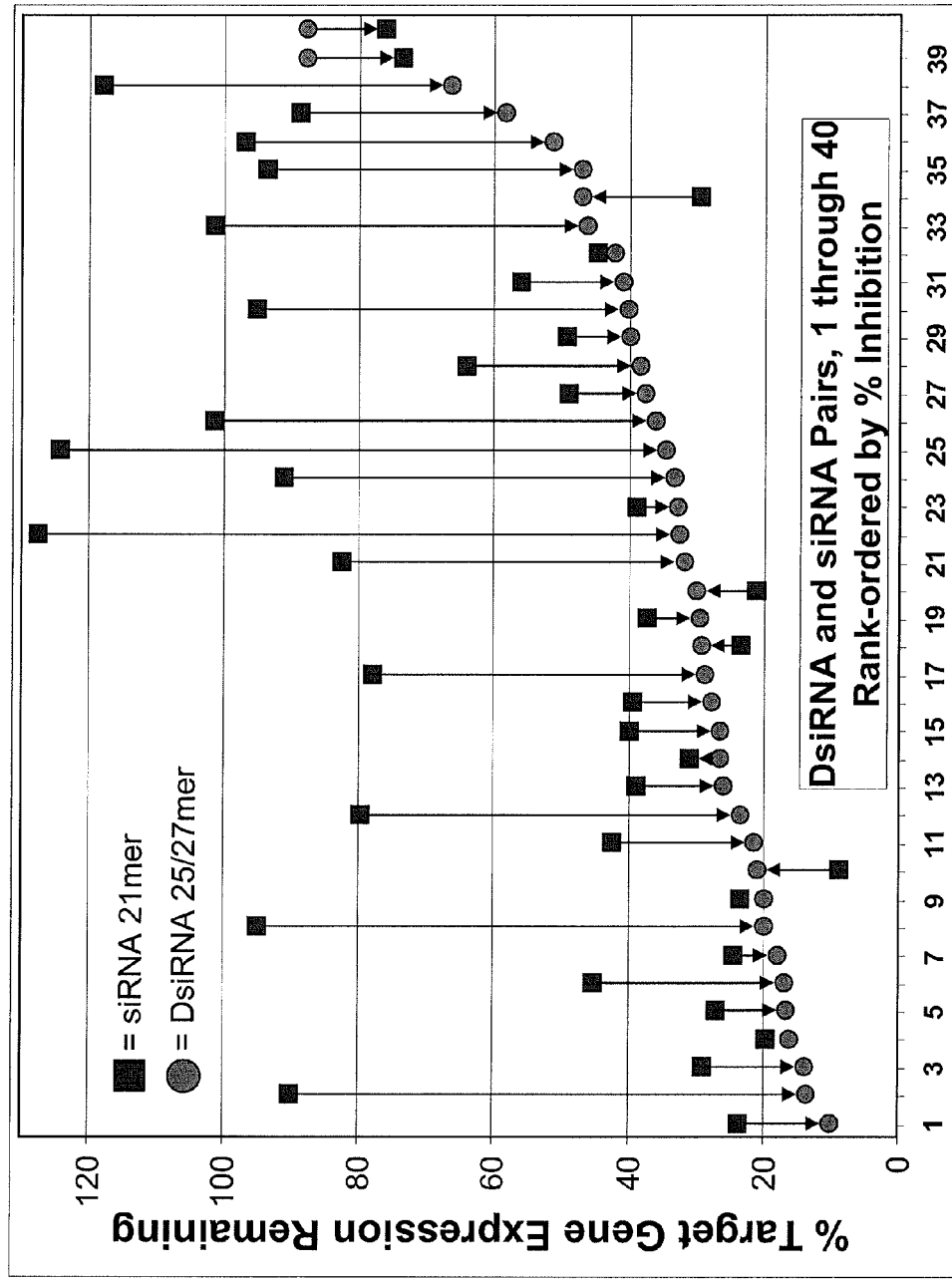

FIG. 8 shows a plot of comparative inhibitory efficacies between anti-KRAS DsiRNA 25/27mers and their cognate 21mer siRNAs. The plot is arranged in rank-order by % inhibition of KRAS target gene by the 25/27mer DsiRNA agent. Arrows indicate the difference in efficacy observed between DsiRNA agent and corresponding siRNA agent. Squares indicate siRNA inhibitory results; circles indicate DsiRNA inhibitory results.

Figure 9:
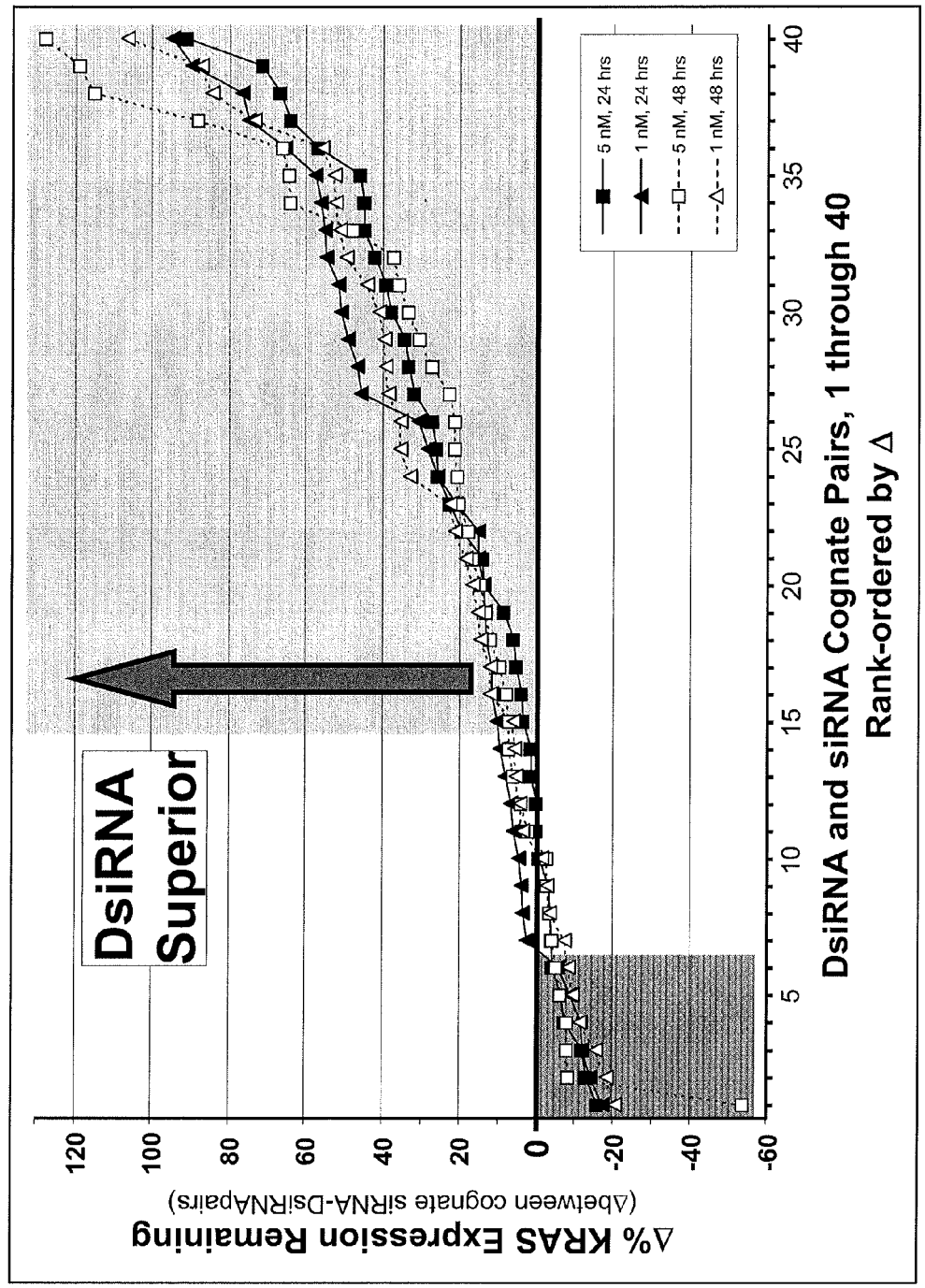

FIG. 9 shows a graph of inhibitory results arranged in rank-order by amount of difference in inhibitory effect between DsiRNA agents and their cognate siRNAs. Both DsiRNAs and siRNAs were tested at 24 hours post-administration at both 5 nM (shaded squares) and 1 nM (shaded triangles), and at 48 hours post administration at both 5 nM (open squares) and 1 nM (open triangles). Shaded regions indicate agents for which a statistically significant difference was observed between DsiRNA and cognate siRNA. For 26 of the 40 tested anti-KRAS DsiRNA agents, statistically significant DsiRNA superiority was observed, as compared to only six of forty siRNA agents that outperformed DsiRNA agents.

Figure 10:
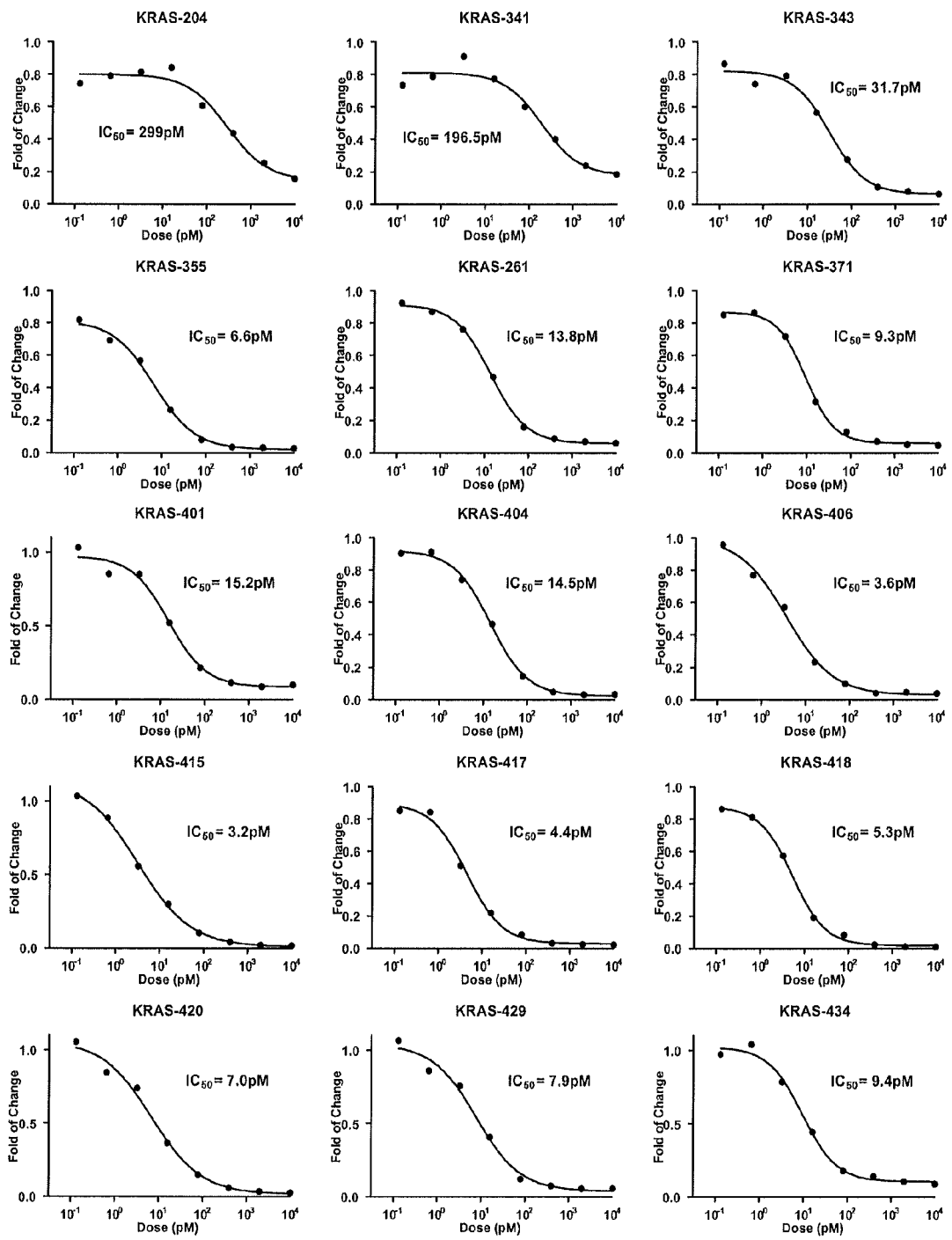
Figure 11:
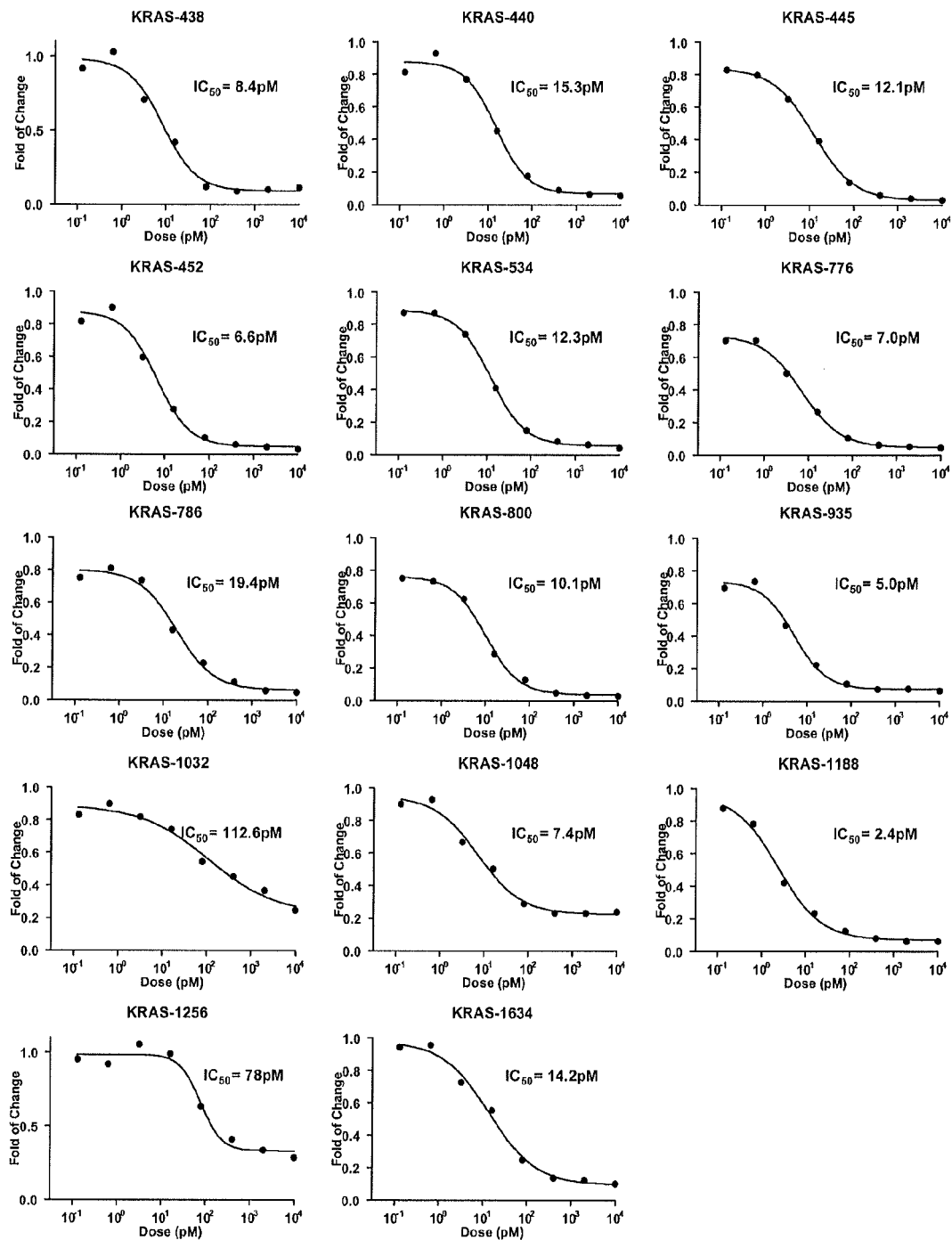
Figure 12:
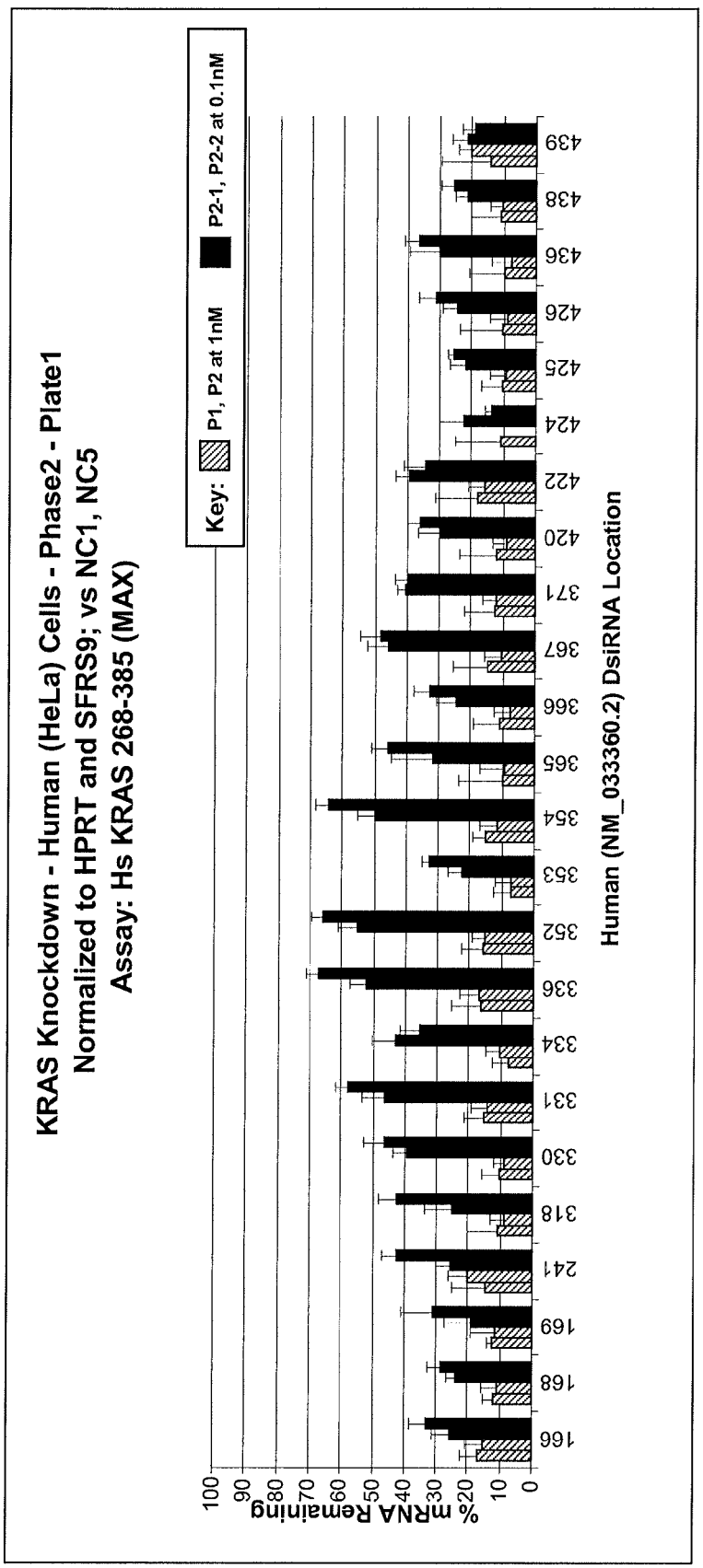
Figure 13:
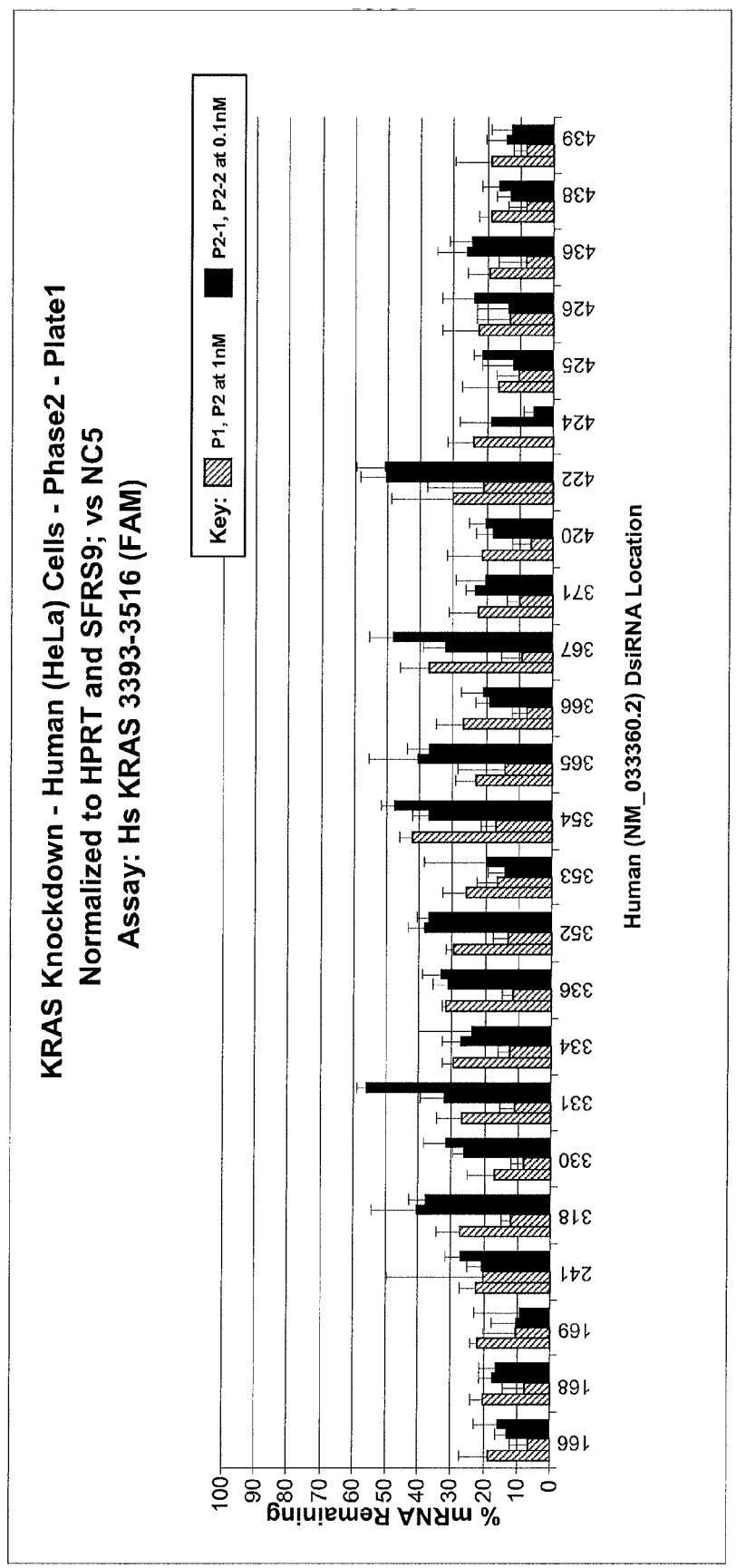
Figure 14:
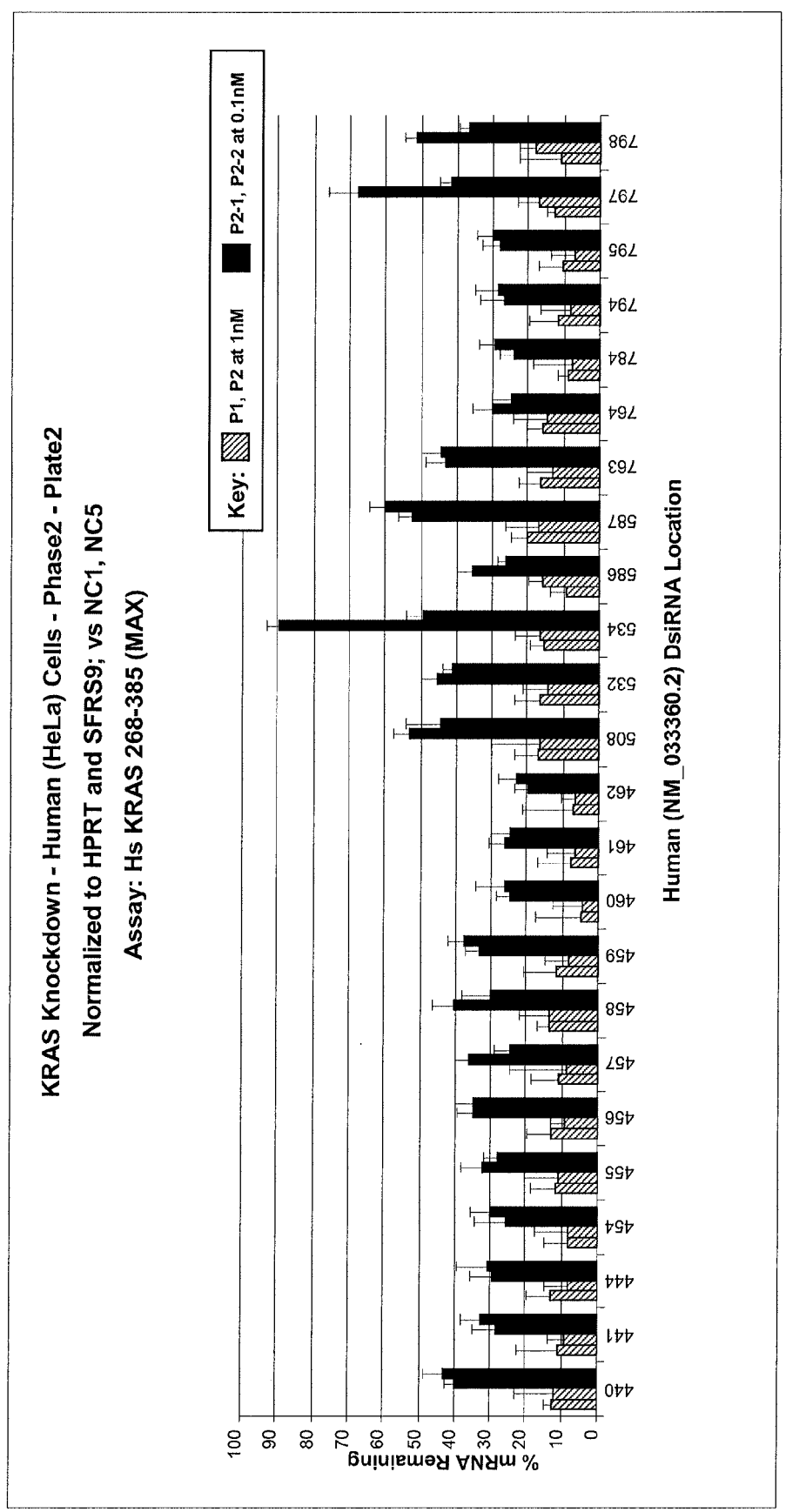
Figure 15:
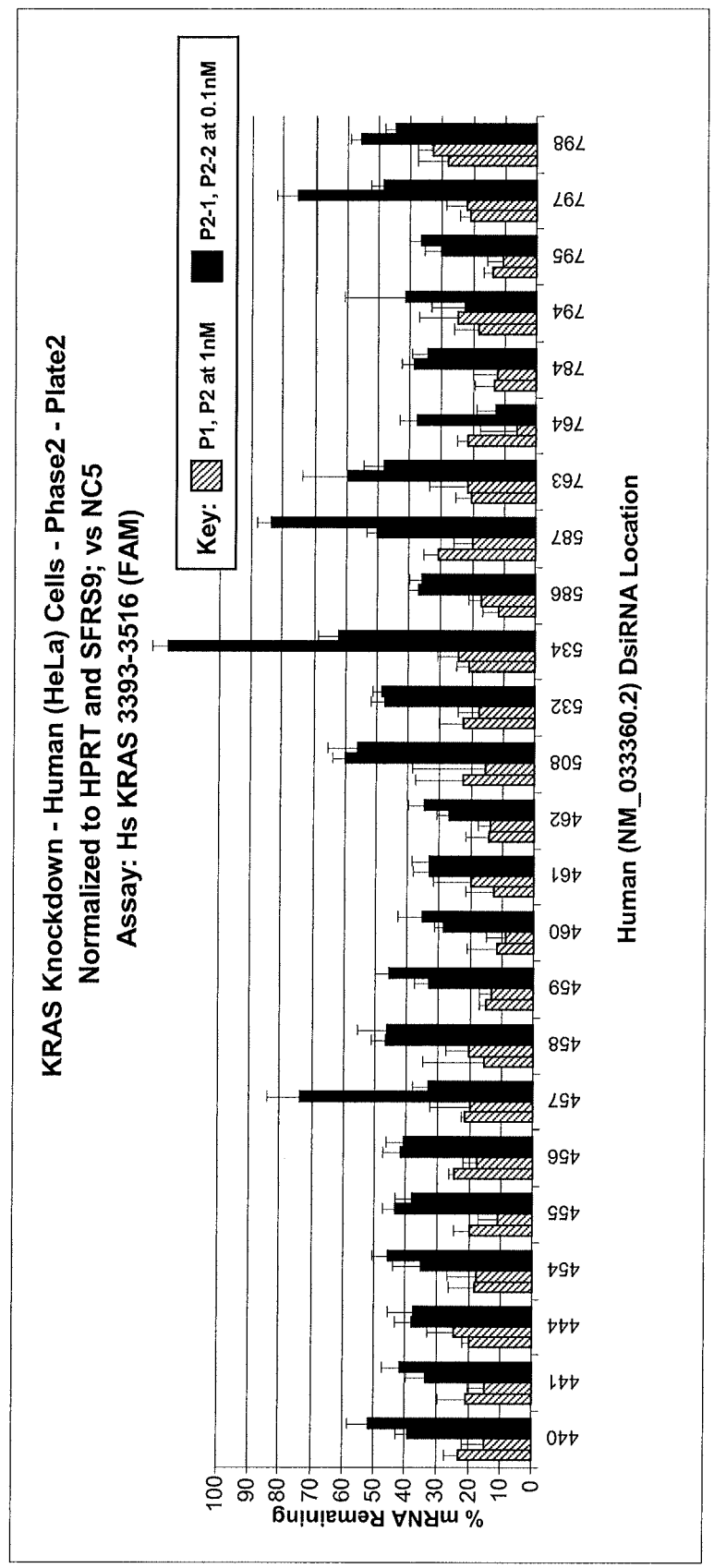
Figure 16:
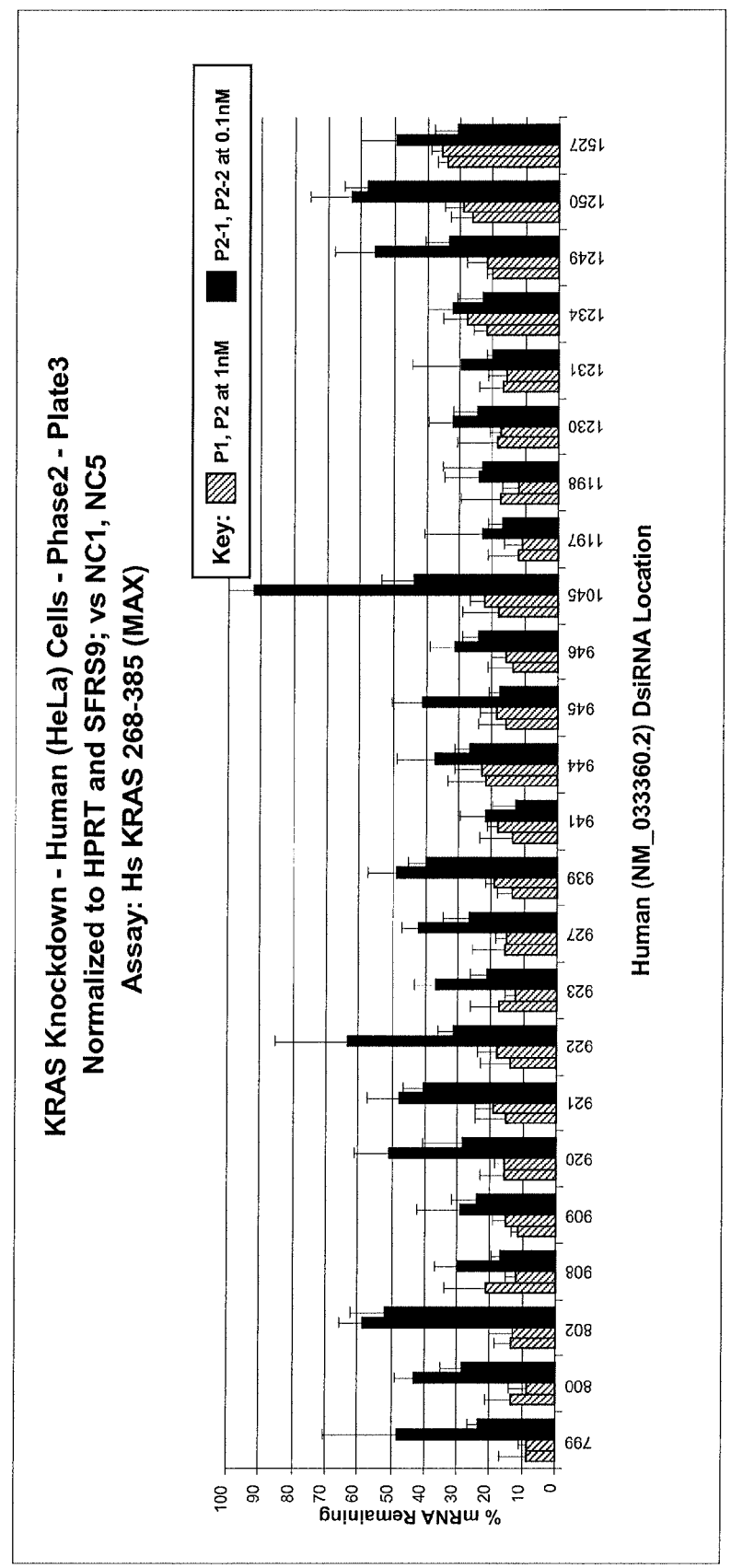
Figure 17:
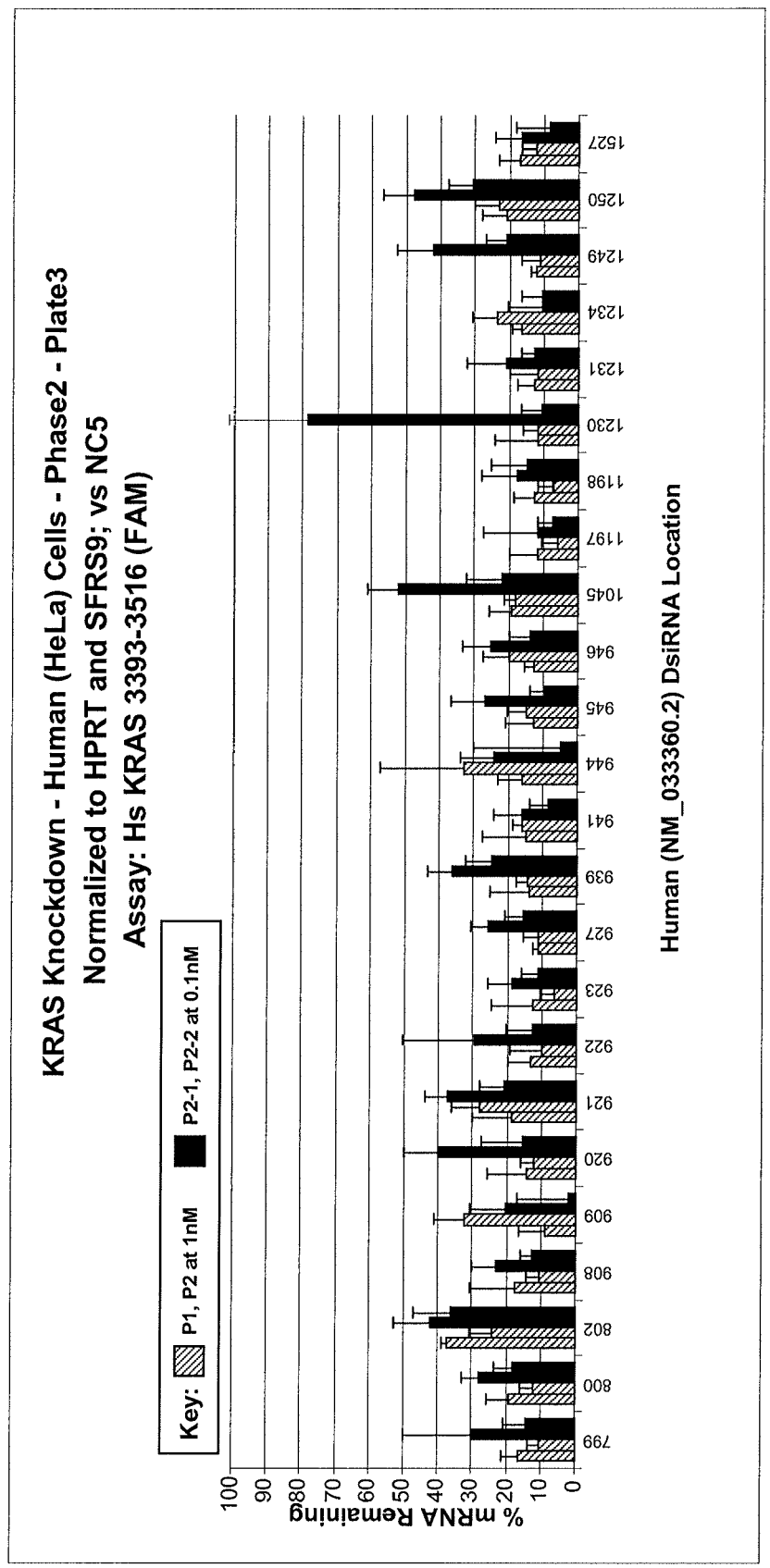
Figure 18:
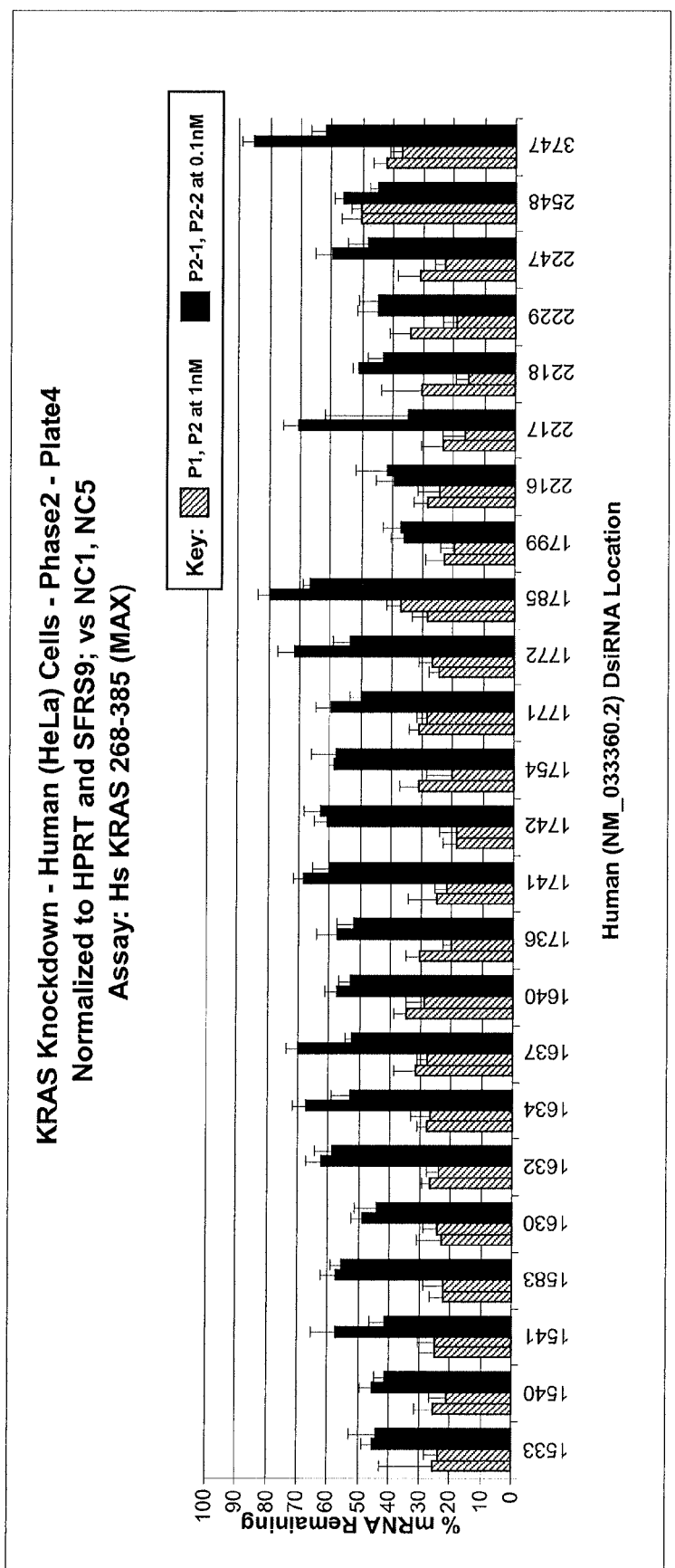
Figure 19:
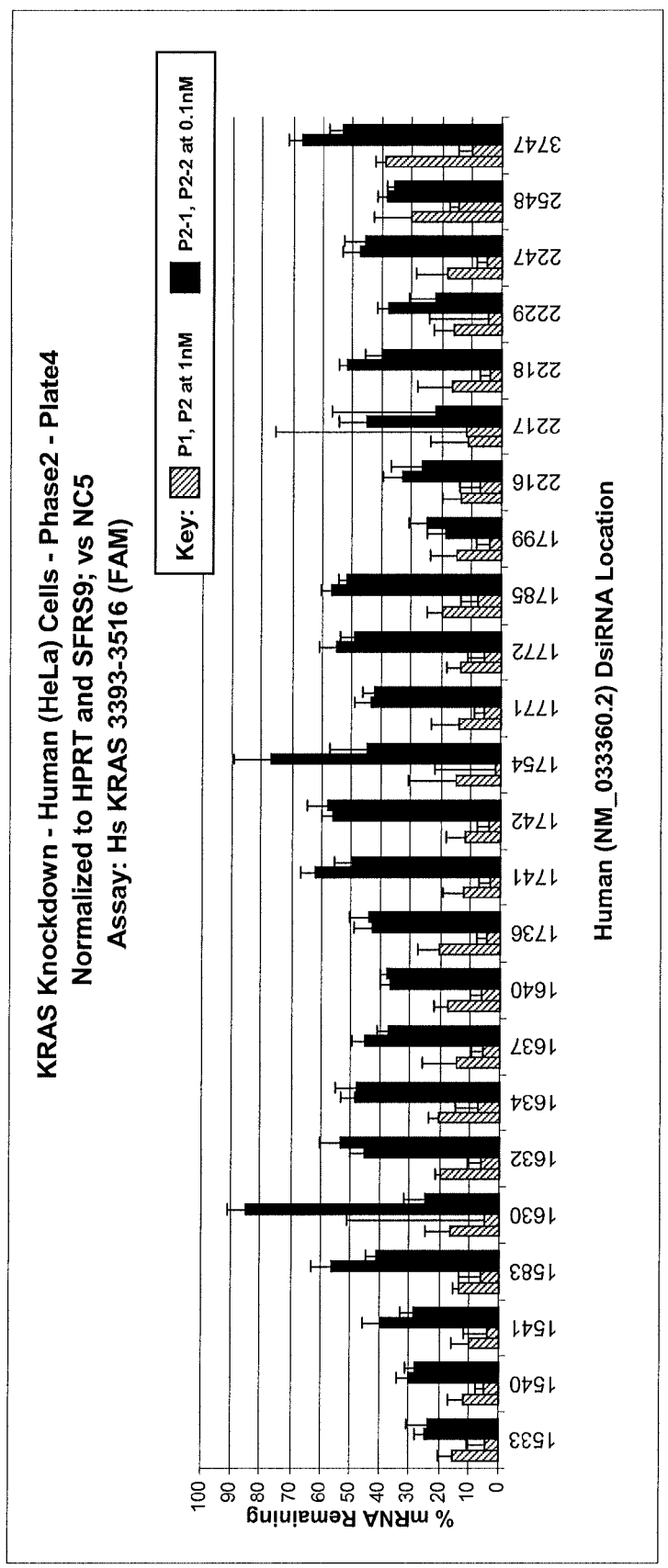
Figure 20:
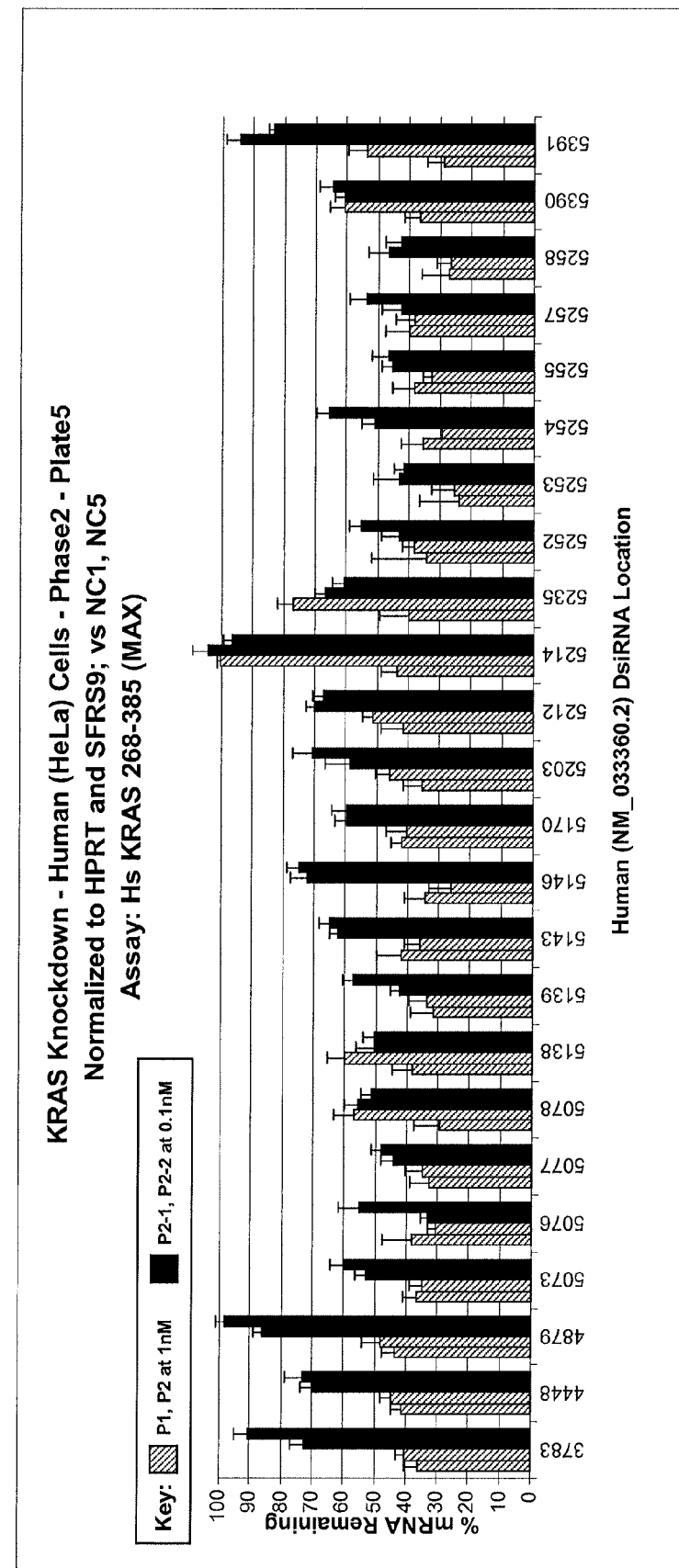
Figure 21:
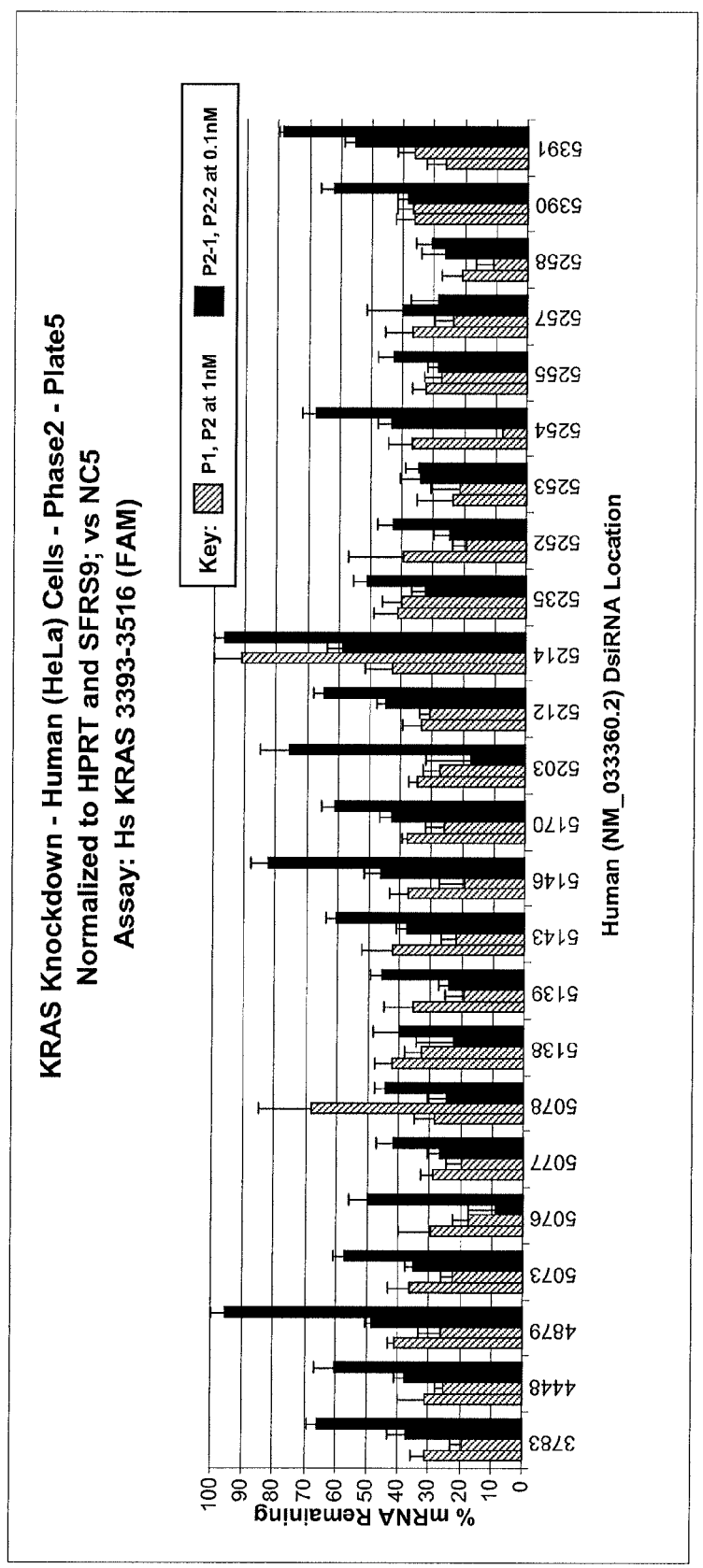
Figure 22:
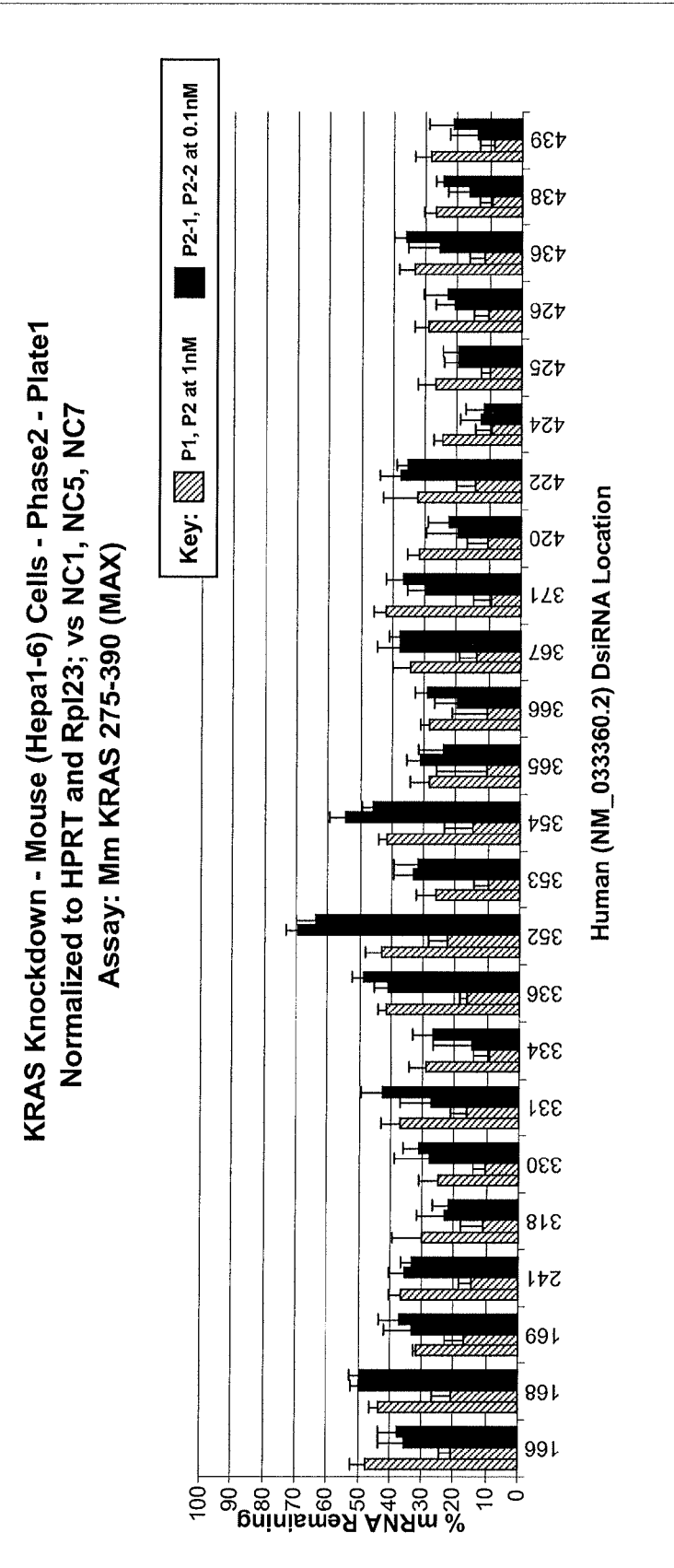
Figure 23:
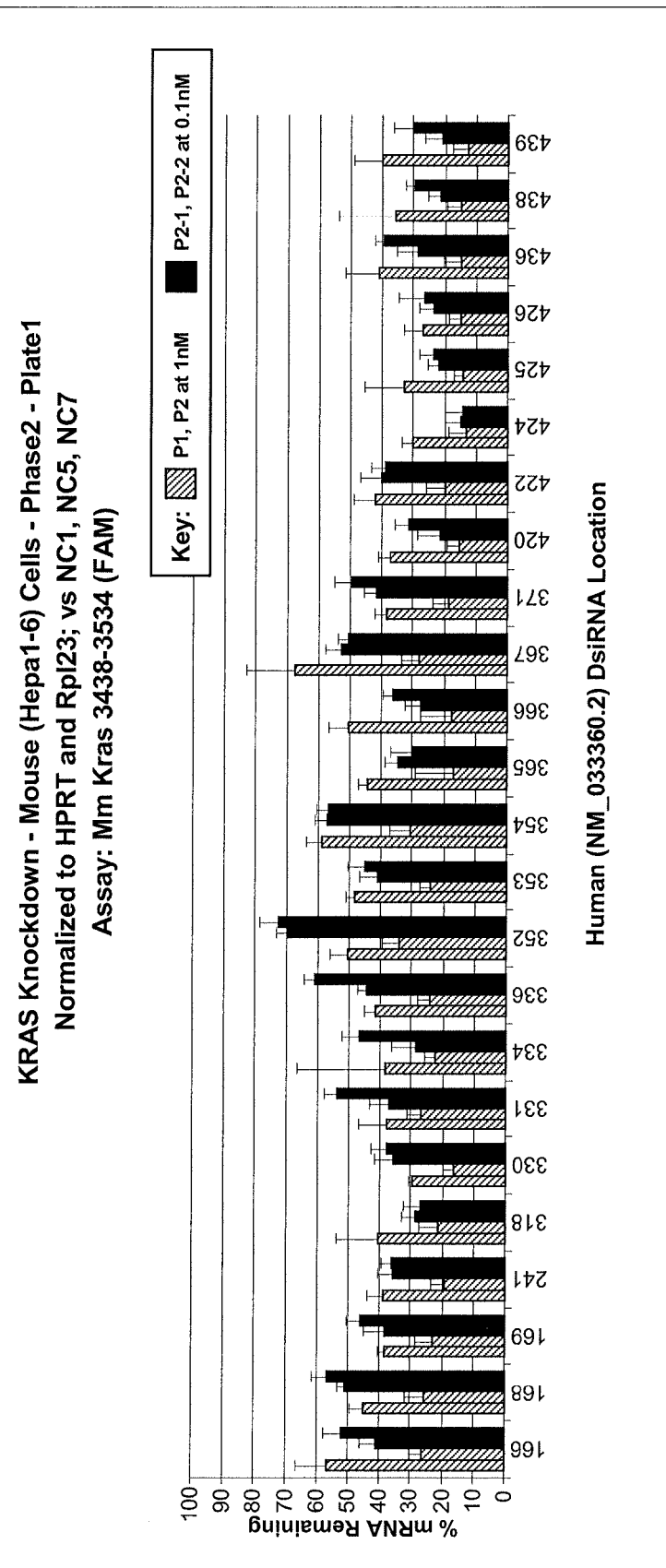
Figure 24:
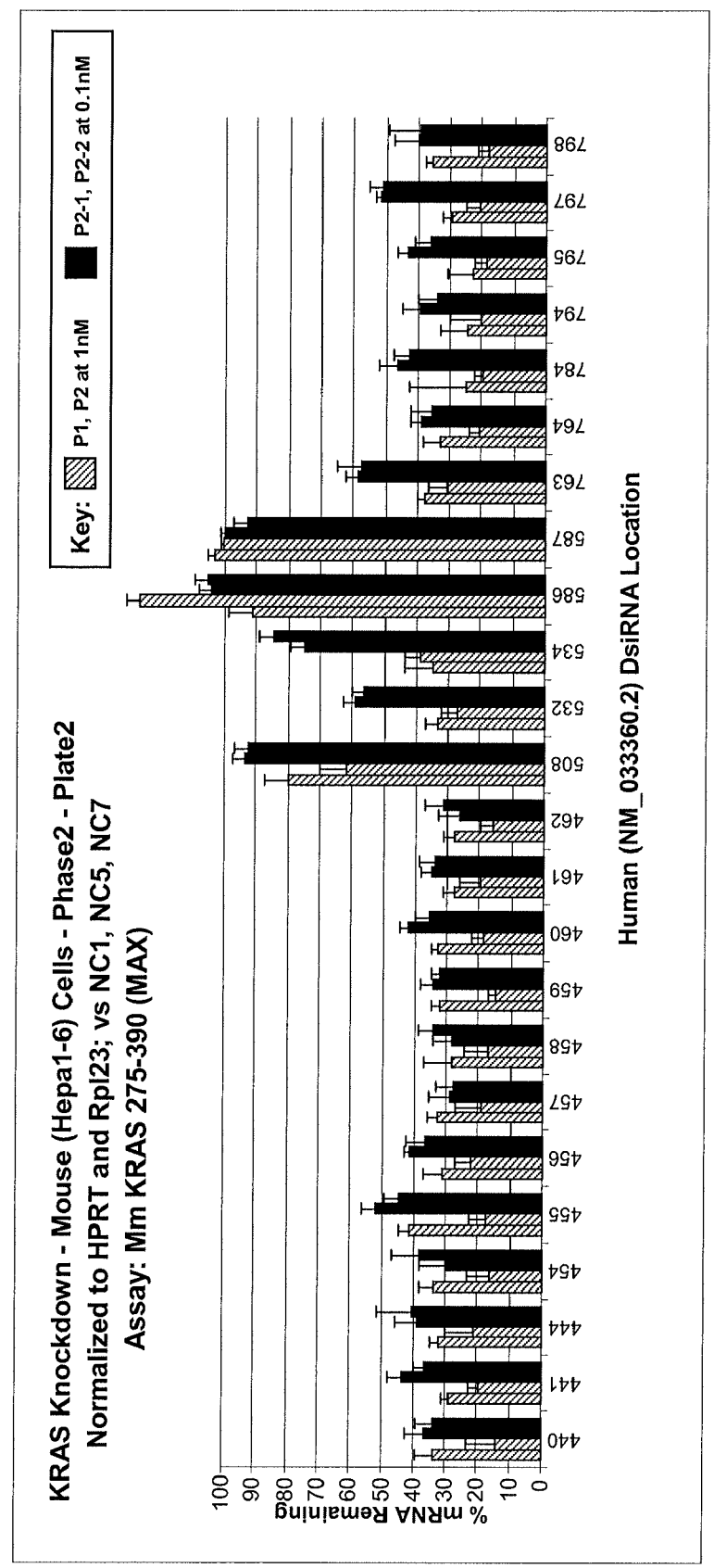
Figure 25:
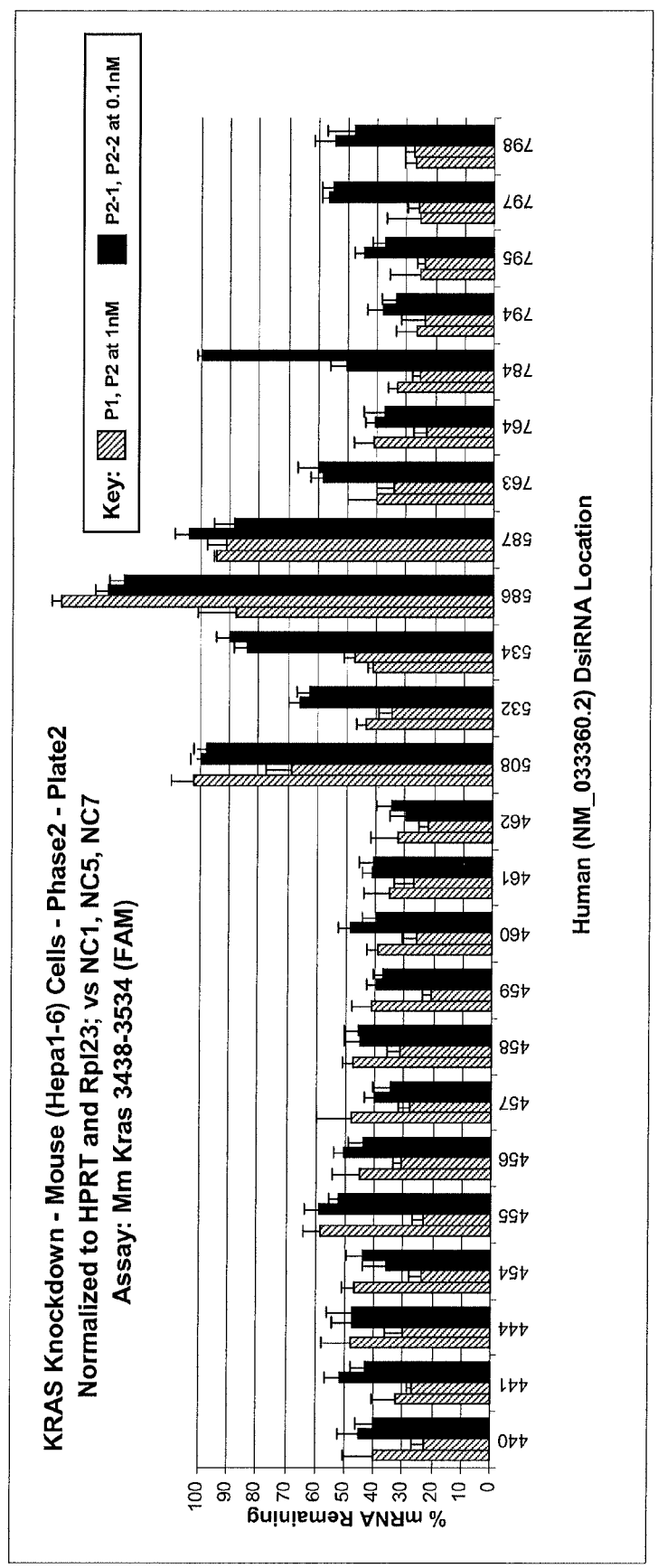
Figure 26:
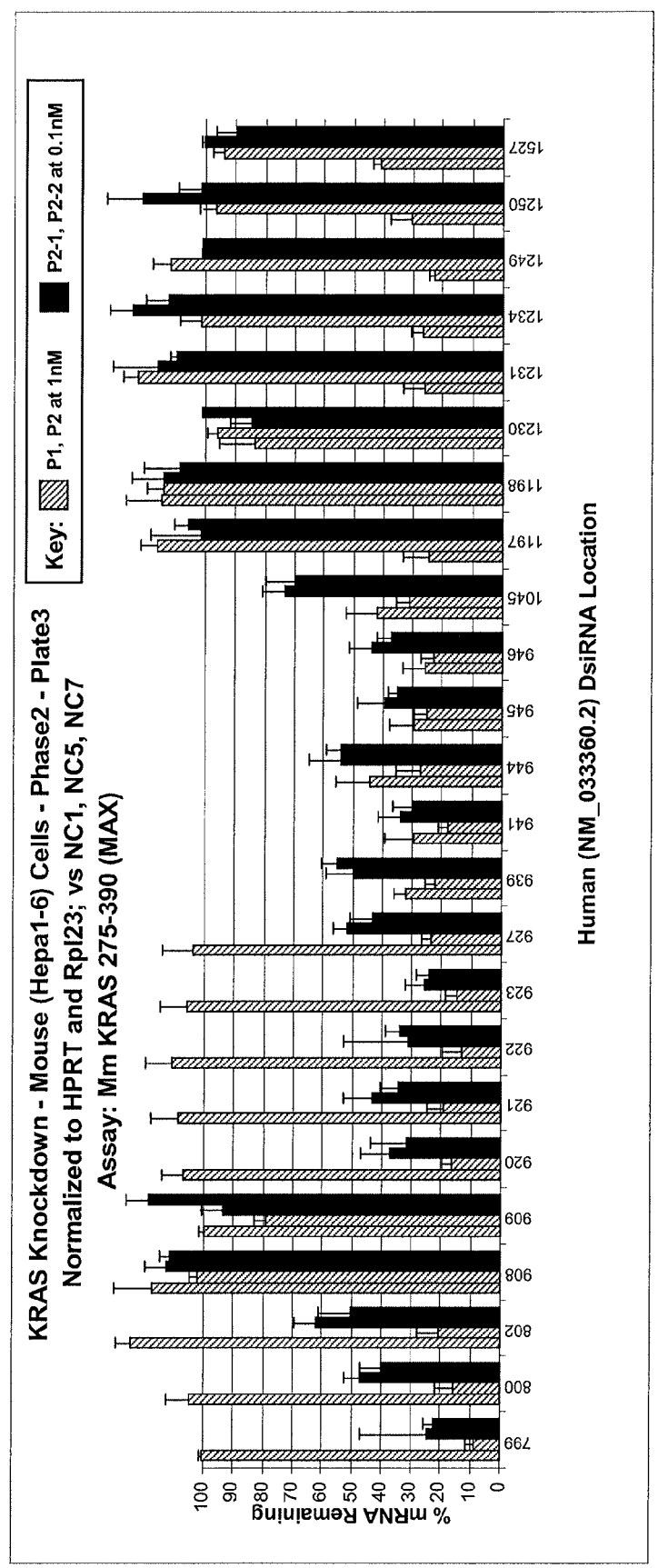
Figure 27:
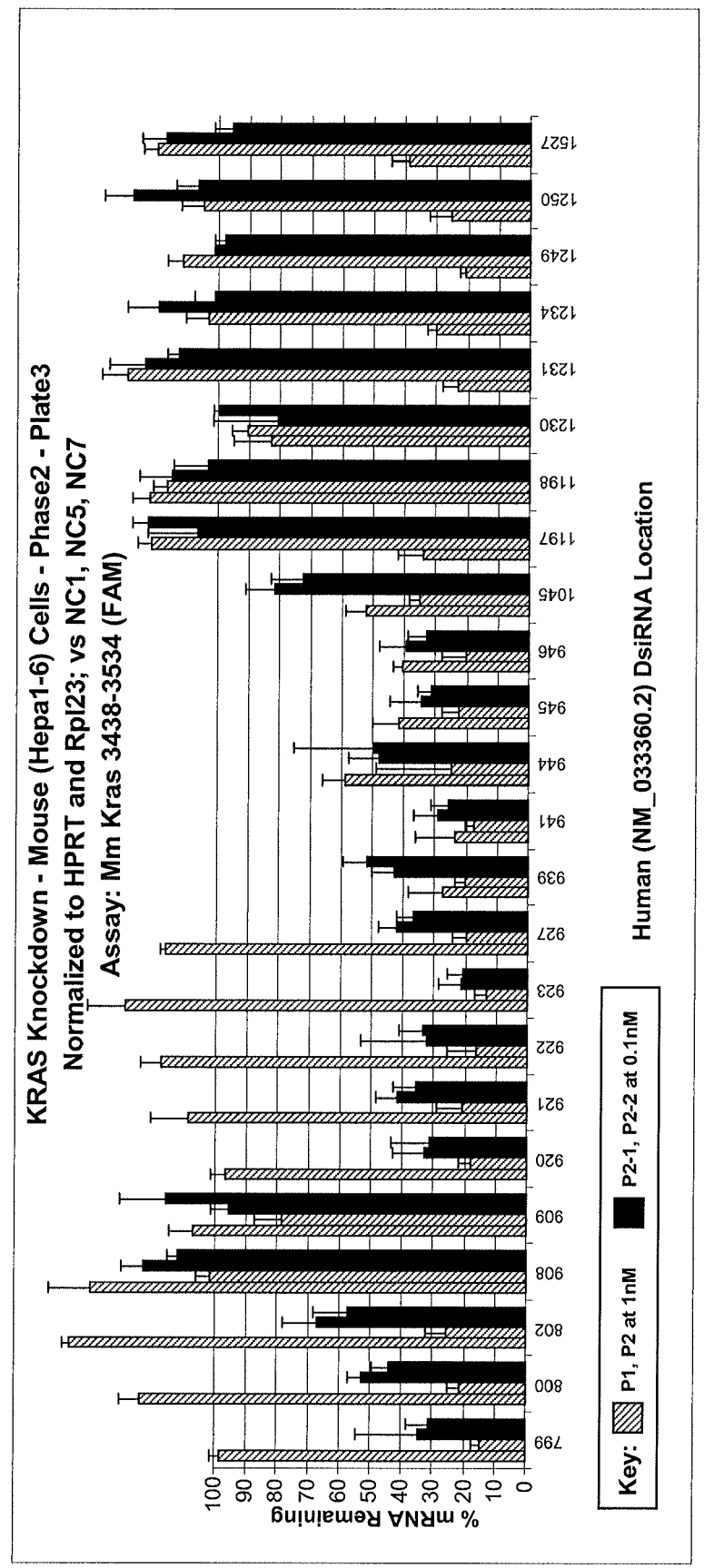
Figure 28:
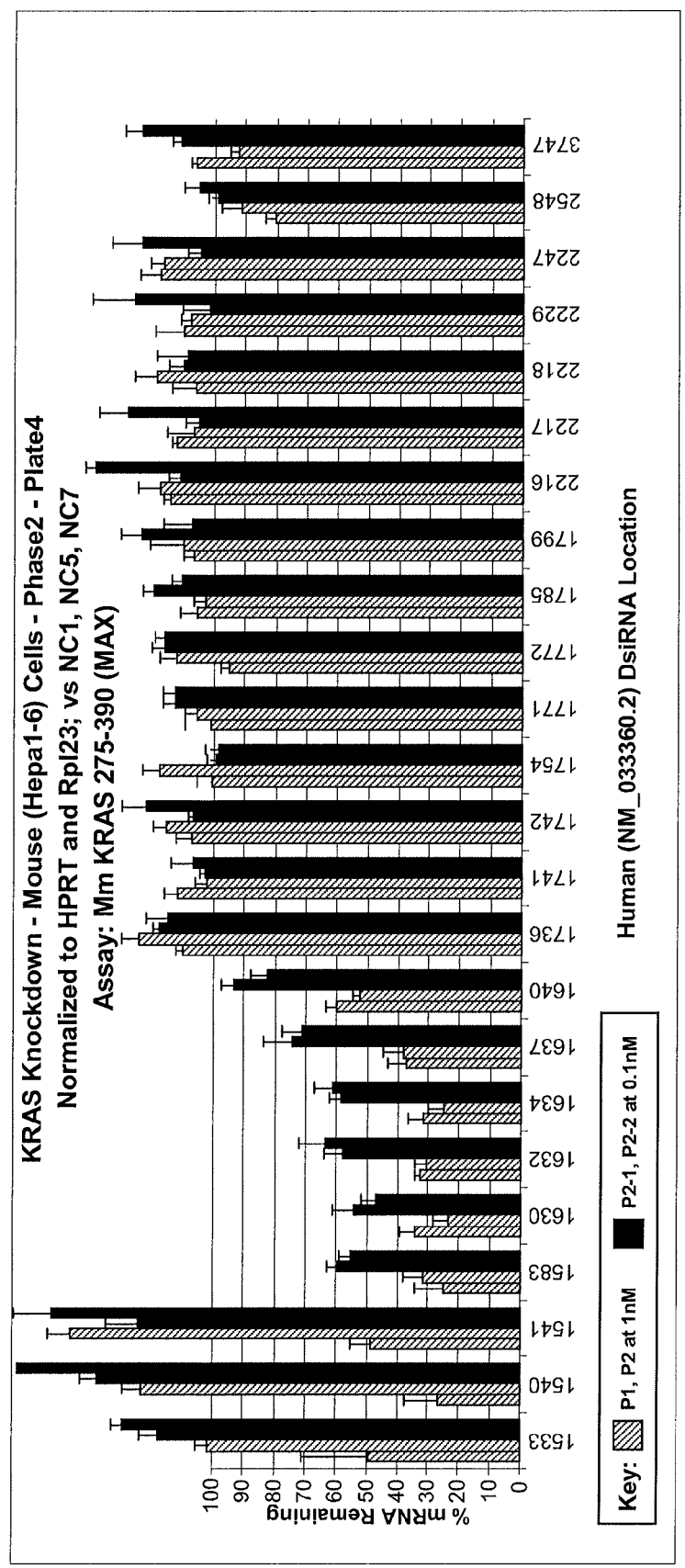
Figure 29:
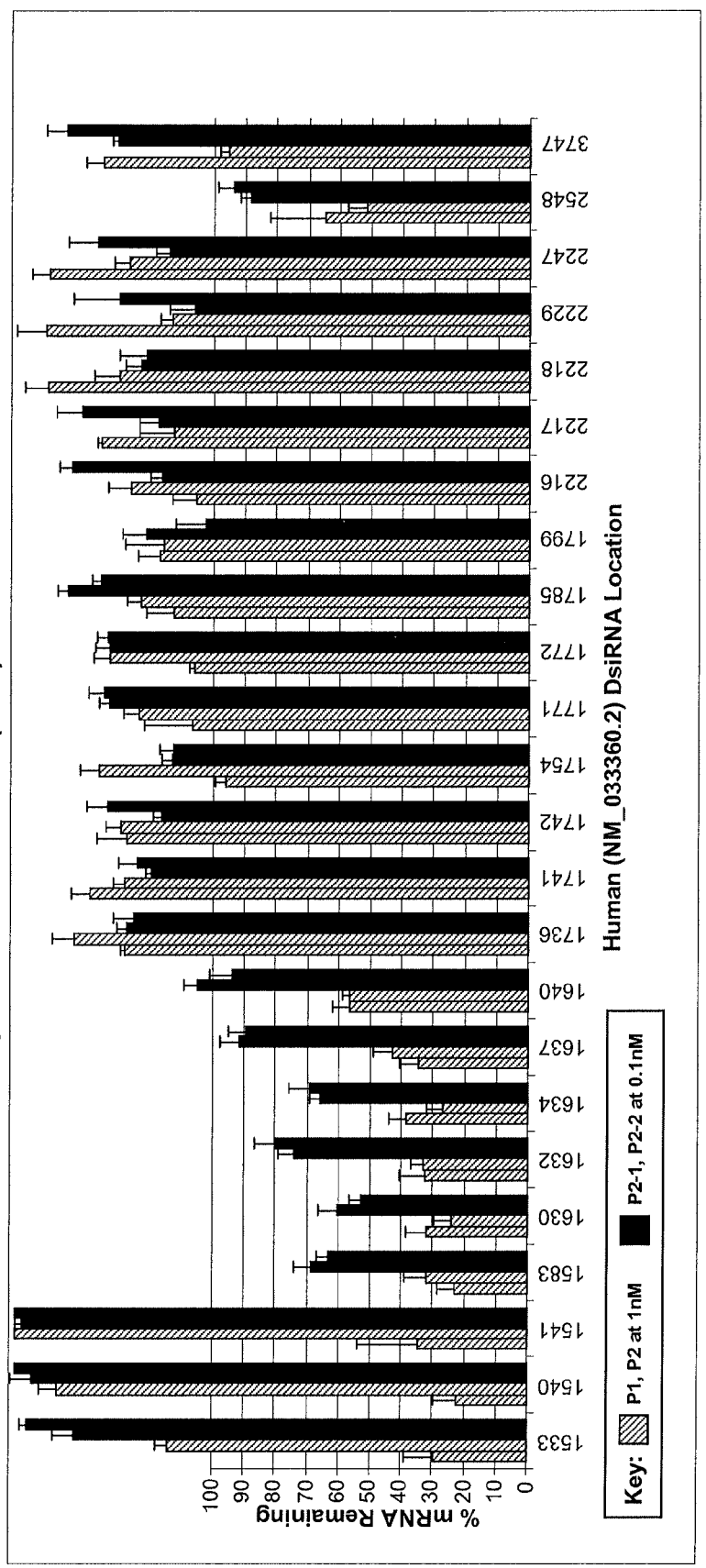
Figure 30:
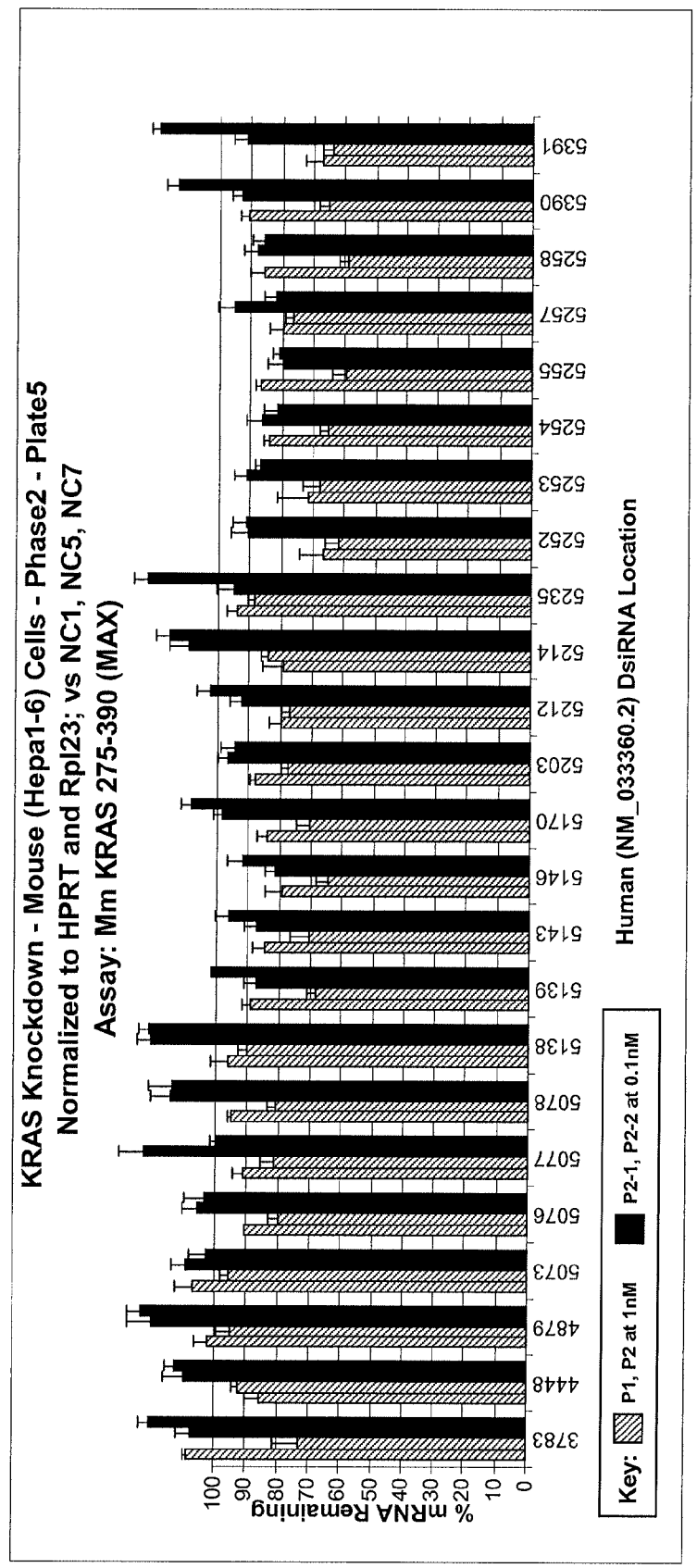
Figure 31:
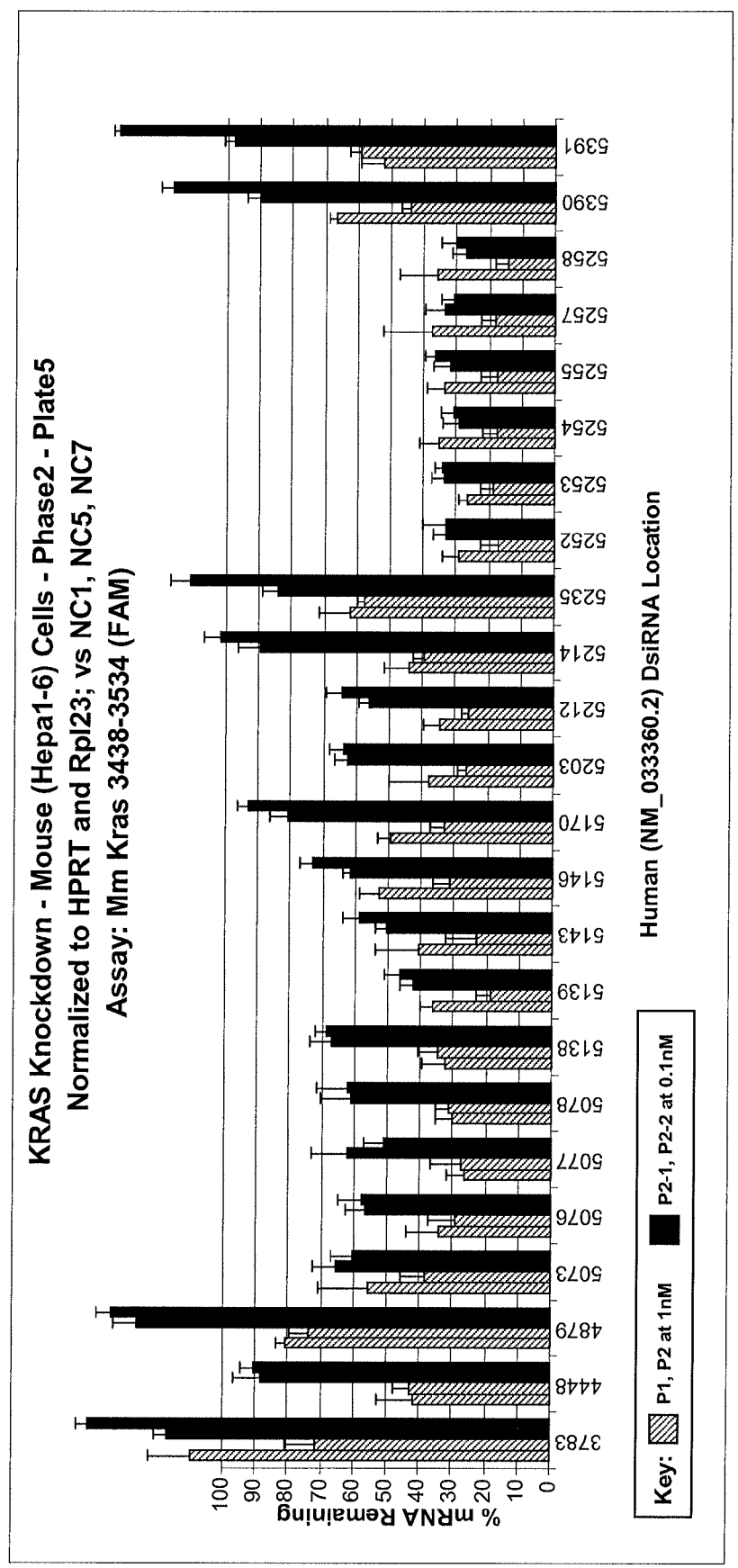

FIGS. 10 and 11 show IC-50 curves observed for indicated human KRAS-targeting DsiRNAs.

FIGS. 12-21 show histograms of human KRAS inhibitory efficacies observed for indicated DsiRNAs. "P1" indicates phase 1, while "P2" indicates phase 2. In phase 1, DsiRNAs were tested at 1 nM in the environment of HeLa cells. In phase 2, DsiRNAs were tested at 1 nM and at 0.1 nM (with duplicate experiments run at 0.1 nM) in the environment of HeLa cells. Individual bars represent average human KRAS levels observed in triplicate, with standard errors shown. Human KRAS levels were normalized to HPRT and SFRS9 levels.

FIGS. 22-31 show histograms of mouse KRAS inhibitory efficacies observed for indicated DsiRNAs. "P1" indicates phase 1, while "P2" indicates phase 2. In phase 1, DsiRNAs were tested at 1 nM in the environment of mouse Hepa 1-6 cells. In phase 2, DsiRNAs were tested at 1 nM and at 0.1 nM (with duplicate experiments run at 0.1 nM) in the environment of mouse Hepa 1-6 cells. Individual bars represent average mouse KRAS levels observed in triplicate, with standard errors shown. Mouse KRAS levels were normalized to HPRT and Rp123 levels.

DETAILED DESCRIPTION OF THE INVENTION

The present invention is directed to compositions that contain double stranded RNA ("dsRNA"), and methods for preparing them, that are capable of reducing the level and/or expression of the KRAS gene in vivo or in vitro. One of the strands of the dsRNA contains a region of nucleotide sequence that has a length that ranges from 19 to 35 nucleotides that can direct the destruction and/or translational inhibition of the targeted KRAS transcript.

Definitions

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). As used herein, the following terms have the meanings ascribed to them below, unless specified otherwise.

The present invention features one or more DsiRNA molecules that can modulate (e.g., inhibit) KRAS expression. The DsiRNAs of the invention optionally can be used in combination with modulators of other genes and/or gene products associated with the maintenance or development of diseases or disorders associated with KRAS misregulation (e.g., tumor formation and/or growth, etc.). The DsiRNA agents of the invention modulate KRAS RNAs such as those corresponding to the cDNA sequences referred to by GenBank Accession Nos. NM_033360 and NM_004985, which are recited below and referred to herein generally as "KRAS."

The below description of the various aspects and embodiments of the invention is provided with reference to exemplary KRAS RNAs, generally referred to herein as KRAS. However, such reference is meant to be exemplary only and the various aspects and embodiments of the invention are also directed to alternate KRAS RNAs, such as mutant KRAS RNAs or additional KRAS splice variants. Certain aspects and embodiments are also directed to other genes involved in KRAS pathways, including genes whose misregulation acts in association with that of KRAS (or is affected or affects KRAS regulation) to produce phenotypic effects that may be targeted for treatment (e.g., tumor formation and/or growth, etc.). Such additional genes can be targeted using DsiRNA and the methods described herein for use of KRAS targeting DsiRNAs. Thus, the inhibition and the effects of such inhibition of the other genes can be performed as described herein.

The term "KRAS" refers to nucleic acid sequences encoding a KRas protein, peptide, or polypeptide (e.g., KRAS transcripts, such as the sequences of KRAS Genbank Accession Nos. NM_033360.2 and NM_004985.3). In certain embodiments, the term "KRAS" is also meant to include other KRAS encoding sequence, such as other KRAS isoforms, mutant KRAS genes, splice variants of KRAS genes, and KRAS gene polymorphisms. The term "Kras" is used to refer to the polypeptide gene product of a KRAS gene/transript, e.g., a Kras protein, peptide, or polypeptide, such as those encoded by KRAS Genbank Accession Nos. NM_033360.2 and NM_004985.3.

As used herein, a "KRAS-associated disease or disorder" refers to a disease or disorder known in the art to be associated with altered KRAS expression, level and/or activity. Notably, a "KRAS-associated disease or disorder" includes cancer and/or proliferative diseases, conditions, or disorders.

By "proliferative disease" or "cancer" as used herein is meant, a disease, condition, trait, genotype or phenotype characterized by unregulated cell growth or replication as is known in the art; including leukemias, for example, acute myelogenous leukemia (AML), chronic myelogenous leukemia (CML), acute lymphocytic leukemia (ALL), and chronic lymphocytic leukemia, AIDS related cancers such as Kaposi's sarcoma; breast cancers; bone cancers such as Osteosarcoma, Chondrosarcomas, Ewing's sarcoma, Fibrosarcomas, Giant cell tumors, Adamantinomas, and Chordomas; Brain cancers such as Meningiomas, Glioblastomas, Lower-Grade Astrocytomas, Oligodendrocytomas, Pituitary Tumors, Schwannomas, and Metastatic brain cancers; cancers of the head and neck including various lymphomas such as mantle cell lymphdma, non-Hodgkins lymphoma, adenoma, squamous cell carcinoma, laryngeal carcinoma, gallbladder and bile duct cancers, cancers of the retina such as retinoblastoma, cancers of the esophagus, gastric cancers, multiple myeloma, ovarian cancer, uterine cancer, thyroid cancer, testicular cancer, endometrial cancer, melanoma, colorectal cancer, lung cancer, bladder cancer, prostate cancer, lung cancer (including non-small cell lung carcinoma), pancreatic cancer, sarcomas, Wilms' tumor, cervical cancer, head and neck cancer, skin cancers, nasopharyngeal carcinoma, liposarcoma, epithelial carcinoma, renal cell carcinoma, gallbladder adenocarcinoma, parotid adenocarcinoma, endometrial sarcoma, multidrug resistant cancers; and proliferative diseases and conditions, such as neovascularization associated with tumor angiogenesis, macular degeneration (e.g., wet/dry AMD), corneal neovascularization, diabetic retinopathy, neovascular glaucoma, myopic degeneration and other proliferative diseases and conditions such as restenosis and polycystic kidney disease, and other cancer or proliferative disease, condition, trait, genotype or phenotype that can respond to the modulation of disease related gene expression in a cell or tissue, alone or in combination with other therapies.

In certain embodiments, DsiRNA-mediated inhibition of a KRAS target sequence is assessed. In such embodiments, KRAS RNA levels can be assessed by art-recognized methods (e.g., RT-PCR, Northern blot, expression array, etc.), optionally via comparison of KRAS levels in the presence of an anti-KRAS DsiRNA of the invention relative to the absence of such an anti-KRAS DsiRNA. In certain embodiments, KRAS levels in the presence of an anti-KRAS DsiRNA are compared to those observed in the presence of vehicle alone, in the presence of a DsiRNA directed against an unrelated target RNA, or in the absence of any treatment.

It is also recognized that levels of Kras protein can be assessed as indicative of KRAS RNA levels and/or the extent to which a DsiRNA inhibits KRAS expression, thus art-recognized methods of assessing KRAS protein levels (e.g., Western blot, immunoprecipitation, other antibody-based methods, etc.) can also be employed to examine the inhibitory effect of a DsiRNA of the invention. An anti-KRAS DsiRNA of the invention is deemed to possess "KRAS inhibitory activity" if a statistically significant reduction in KRAS RNA or protein levels is seen when an anti-KRAS DsiRNA of the invention is administered to a system (e.g., cell-free in vitro system), cell, tissue or organism, as compared to an appropriate control. The distribution of experimental values and the number of replicate assays performed will tend to dictate the parameters of what levels of reduction in KRAS RNA or protein (either as a % or in absolute terms) is deemed statistically significant (as assessed by standard methods of determining statistical significance known in the art). However, in certain embodiments, "KRAS inhibitory activity" is defined based upon a % or absolute level of reduction in the level of KRAS in a system, cell, tissue or organism. For example, in certain embodiments, a DsiRNA of the invention is deemed to possess KRAS inhibitory activity if at least a 5% reduction or at least a 10% reduction in KRAS RNA is observed in the presence of a DsiRNA of the invention relative to KRAS levels seen for a suitable control. (For example, in vivo KRAS levels in a tissue and/or subject can, in certain embodiments, be deemed to be inhibited by a DsiRNA agent of the invention if, e.g., a 5% or 10% reduction in KRAS levels is observed relative to a control.) In certain other embodiments, a DsiRNA of the invention is deemed to possess KRAS inhibitory activity if KRAS RNA levels are observed to be reduced by at least 15% relative to an appropriate control, by at least 20% relative to an appropriate control, by at least 25% relative to an appropriate control, by at least 30% relative to an appropriate control, by at least 35% relative to an appropriate control, by at least 40% relative to an appropriate control, by at least 45% relative to an appropriate control, by at least 50% relative to an appropriate control, by at least 55% relative to an appropriate control, by at least 60% relative to an appropriate control, by at least 65% relative to an appropriate control, by at least 70% relative to an appropriate control, by at least 75% relative to an appropriate control, by at least 80% relative to an appropriate control, by at least 85% relative to an appropriate control, by at least 90% relative to an appropriate control, by at least 95% relative to an appropriate control, by at least 96% relative to an appropriate control, by at least 97% relative to an appropriate control, by at least 98% relative to an appropriate control or by at least 99% relative to an appropriate control. In some embodiments, complete inhibition of KRAS is required for a DsiRNA to be deemed to possess KRAS inhibitory activity. In certain models (e.g., cell culture), a DsiRNA is deemed to possess KRAS inhibitory activity if at least a 50% reduction in KRAS levels is observed relative to a suitable control. In certain other embodiments, a DsiRNA is deemed to possess KRAS inhibitory activity if at least an 80% reduction in KRAS levels is observed relative to a suitable control.

KRAS inhibitory activity can also be evaluated over time (duration) and over concentration ranges (potency), with assessment of what constitutes a DsiRNA possessing KRAS inhibitory activity adjusted in accordance with concentrations administered and duration of time following administration. Thus, in certain embodiments, a DsiRNA of the invention is deemed to possess KRAS inhibitory activity if at least a 50% reduction in KRAS activity is observed at a duration of time of 2 hours, 5 hours, 10 hours, 1 day, 2 days, 3 days, 4 days, 5 days, 6 days, 7 days, 8 days, 9 days, 10 days or more after administration is observed/persists. In additional embodiments, a DsiRNA of the invention is deemed to be a potent KRAS inhibitory agent if KRAS inihibitory activity (e.g., in certain embodiments, at least 50% inhibition of KRAS) is observed at a concentration of 1 nM or less, 500 pM or less, 200 pM or less, 100 pM or less, 50 pM or less, 20 pM or less, 10 pM or less, 5 pM or less, 2 pM or less or even 1 pM or less in the environment of a cell.

In certain embodiments, the phrase "consists essentially of" is used in reference to the anti-KRAS DsiRNAs of the invention. In some such embodiments, "consists essentially of" refers to a composition that comprises a DsiRNA of the invention which possesse at least a certain level of KRAS inhibitory activity (e.g., at least 50% KRAS inhibitory activity) and that also comprises one or more additional components and/or modifications that do not significantly impact the KRAS inhibitory activity of the DsiRNA. For example, in certain embodiments, a composition "consists essentially of" a DsiRNA of the invention where modifications of the DsiRNA of the invention and/or DsiRNA-associated components of the composition do not alter the KRAS inhibitory activity (optionally including potency or duration of KRAS inhibitory activity) by greater than 3%, greater than 5%, greater than 10%, greater than 15%, greater than 20%, greater than 25%, greater than 30%, greater than 35%, greater than 40%, greater than 45%, or greater than 50% relative to the DsiRNA of the invention in isolation. In certain embodiments, a composition is deemed to consist essentially of a DsiRNA of the invention even if more dramatic reduction of KRAS inhibitory activity (e.g., 80% reduction, 90% reduction, etc. in efficacy, duration and/or potency) occurs in the presence of additional components or modifications, yet where KRAS inhibitory activity is not significantly elevated (e.g., observed levels of KRAS inhibitory activity are within 10% those observed for the isolated DsiRNA of the invention) in the presence of additional components and/or modifications.

As used herein, the term "nucleic acid" refers to deoxyribonucleotides, ribonucleotides, or modified nucleotides, and polymers thereof in single- or double-stranded form. The term encompasses nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, phosphorothioates, phosphoramidates, methyl phosphonates, chiral-methyl phosphonates, 2-O-methyl ribonucleotides, peptide-nucleic acids (PNAs).

As used herein, "nucleotide" is used as recognized in the art to include those with natural bases (standard), and modified bases well known in the art. Such bases are generally located at the 1' position of a nucleotide sugar moiety. Nucleotides generally comprise a base, sugar and a phosphate group. The nucleotides can be unmodified or modified at the sugar, phosphate and/or base moiety, (also referred to interchangeably as nucleotide analogs, modified nucleotides, non-natural nucleotides, non-standard nucleotides and other; see, e.g., Usman and McSwiggen, supra; Eckstein, et al., International PCT Publication No. WO 92/07065; Usman et al, International PCT Publication No. WO 93/15187; Uhlman & Peyman, supra, all are hereby incorporated by reference herein). There are several examples of modified nucleic acid bases known in the art as summarized by Limbach, et al, Nucleic Acids Res. 22:2183, 1994. Some of the non-limiting examples of base modifications that can be introduced into nucleic acid molecules include, hypoxanthine, purine, pyridin-4-one, pyridin-2-one, phenyl, pseudouracil, 2,4,6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine), propyne, and others (Burgin, et al., Biochemistry 35:14090, 1996; Uhlman & Peyman, supra). By "modified bases" in this aspect is meant nucleotide bases other than adenine, guanine, cytosine and uracil at 1' position or their equivalents.

As used herein, "modified nucleotide" refers to a nucleotide that has one or more modifications to the nucleoside, the nucleobase, pentose ring, or phosphate group. For example, modified nucleotides exclude ribonucleotides containing adenosine monophosphate, guanosine monophosphate, uridine monophosphate, and cytidine monophosphate and deoxyribonucleotides containing deoxyadenosine monophosphate, deoxyguanosine monophosphate, deoxythymidine monophosphate, and deoxycytidine monophosphate. Modifications include those naturally occurring that result from modification by enzymes that modify nucleotides, such as methyltransferases. Modified nucleotides also include synthetic or non-naturally occurring nucleotides. Synthetic or non-naturally occurring modifications in nucleotides include those with 2' modifications, e.g., 2'-methoxyethoxy, 2'-fluoro, 2'-allyl, 2'-O-[2-(methylamino)-2-oxoethyl], 4'-thio, 4'-CH$_2$—O-2'-bridge, 4'-(CH$_2$)$_2$—O-2'-bridge, 2'-LNA, and 2'-O—(N-methylcarbamate) or those comprising base analogs. In connection with 2'-modified nucleotides as described for the present disclosure, by "amino" is meant 2'—NH$_2$ or 2'-O—NH$_2$, which can be modified or unmodified. Such modified groups are described, e.g., in Eckstein et al., U.S. Pat. No. 5,672,695 and Matulic-Adamic et al., U.S. Pat. No. 6,248,878.

In reference to the nucleic acid molecules of the present disclosure, modifications may exist upon these agents in patterns on one or both strands of the double stranded ribonucleic acid (dsRNA). As used herein, "alternating positions" refers to a pattern where every other nucleotide is a modified nucleotide or there is an unmodified nucleotide (e.g., an unmodified ribonucleotide) between every modified nucleotide over a defined length of a strand of the dsRNA (e.g., 5'-MNM-NMN-3'; 3'-MNMNMN-5'; where M is a modified nucleotide and N is an unmodified nucleotide). The modification pattern starts from the first nucleotide position at either the 5' or 3' terminus according to a position numbering convention, e.g., as described herein (in certain embodiments, position 1 is designated in reference to the terminal residue of a strand following a projected Dicer cleavage event of a DsiRNA agent of the invention; thus, position 1 does not always constitute a 3' terminal or 5' terminal residue of a pre-processed agent of the invention). The pattern of modified nucleotides at alternating positions may run the full length of the strand, but in certain embodiments includes at least 4, 6, 8, 10, 12, 14 nucleotides containing at least 2, 3, 4, 5, 6 or 7 modified nucleotides, respectively. As used herein, "alternating pairs of positions" refers to a pattern where two consecutive modified nucleotides are separated by two consecutive unmodified nucleotides over a defined length of a strand of the dsRNA (e.g., 5'-MMNNMMNNMMNN-3'; 3'-MMNNMMNNM-MNN-5'; where M is a modified nucleotide and N is an unmodified nucleotide). The modification pattern starts from the first nucleotide position at either the 5' or 3' terminus according to a position numbering convention such as those described herein. The pattern of modified nucleotides at alternating positions may run the full length of the strand, but preferably includes at least 8, 12, 16, 20, 24, 28 nucleotides containing at least 4, 6, 8, 10, 12 or 14 modified nucleotides, respectively. It is emphasized that the above modification patterns are exemplary and are not intended as limitations on the scope of the invention.

As used herein, "base analog" refers to a heterocyclic moiety which is located at the 1' position of a nucleotide sugar moiety in a modified nucleotide that can be incorporated into a nucleic acid duplex (or the equivalent position in a nucleotide sugar moiety substitution that can be incorporated into a nucleic acid duplex). In the dsRNAs of the invention, a base analog is generally either a purine or pyrimidine base excluding the common bases guanine (G), cytosine (C), adenine (A), thymine (T), and uracil (U). Base analogs can duplex with other bases or base analogs in dsRNAs. Base analogs include those useful in the compounds and methods of the invention, e.g., those disclosed in U.S. Pat. Nos. 5,432,272 and 6,001,983 to Benner and US Patent Publication No. 20080213891 to Manoharan, which are herein incorporated by reference. Non-limiting examples of bases include hypoxanthine (I), xanthine (X), 3β-D-ribofuranosyl-(2,6-diaminopyrimidine) (K), 3-β-D-ribofuranosyl-(1-methyl-pyrazolo[4,3-d]pyrimidine-5,7(4H,6H)-dione) (P), iso-cytosine (iso-C), iso-guanine (iso-G), 1-β-D-ribofuranosyl-(5-nitroindole), 1-β-D-ribofuranosyl-(3-nitropyrrole), 5-bromouracil, 2-aminopurine, 4-thio-dT, 7-(2-thienyl)-imidazo[4,5-b]pyridine (Ds) and pyrrole-2-carbaldehyde (Pa), 2-amino-6-(2-thienyl)purine (S), 2-oxopyridine (Y), difluorotolyl, 4-fluoro-6-methylbenzimidazole, 4-methylbenzimidazole, 3-methyl isocarbostyrilyl, 5-methyl isocarbostyrilyl, and 3-methyl-7-propynyl isocarbostyrilyl, 7-azaindolyl, 6-methyl-7-azaindolyl, imidizopyridinyl, 9-methyl-imidizopyridinyl, pyrrolopyrizinyl, isocarbostyrilyl, 7-propynyl isocarbostyrilyl, propynyl-7-azaindolyl, 2,4,5-trimethylphenyl, 4-methylindolyl, 4,6-dimethylindolyl, phenyl, napthalenyl, anthracenyl, phenanthracenyl, pyrenyl, stilbenzyl, tetracenyl, pentacenyl, and structural derivates thereof (Schweitzer et al., J. Org. Chem., 59:7238-7242 (1994); Berger et al., Nucleic Acids Research, 28(15):2911-2914 (2000); Moran et al., J. Am. Chem. Soc., 119:2056-2057 (1997); Morales et al., J. Am. Chem. Soc., 121:2323-2324 (1999); Guckian et al., J. Am. Chem. Soc., 118:8182-8183 (1996); Morales et al., J. Am. Chem. Soc., 122(6):1001-1007 (2000); McMinn et al., J. Am. Chem. Soc., 121:11585-11586 (1999); Guckian et al., J. Org. Chem., 63:9652-9656 (1998); Moran et al., Proc. Natl. Acad. Sci., 94:10506-10511 (1997); Das et al., J. Chem. Soc., Perkin Trans., 1:197-206 (2002); Shibata et al., J. Chem. Soc., Perkin Trans., 1: 1605-1611 (2001); Wu et al., J. Am. Chem. Soc., 122(32):7621-7632 (2000); O'Neill et al., J. Org. Chem., 67:5869-5875 (2002); Chaudhuri et al., J. Am. Chem. Soc., 117:10434-10442 (1995); and U.S. Pat. No. 6,218,108.). Base analogs may also be a universal base.

As used herein, "universal base" refers to a heterocyclic moiety located at the 1' position of a nucleotide sugar moiety in a modified nucleotide, or the equivalent position in a nucleotide sugar moiety substitution, that, when present in a nucleic acid duplex, can be positioned opposite more than one type of base without altering the double helical structure (e.g., the structure of the phosphate backbone). Additionally, the universal base does not destroy the ability of the single stranded nucleic acid in which it resides to duplex to a target nucleic acid. The ability of a single stranded nucleic acid containing a universal base to duplex a target nucleic acid can be assayed by methods apparent to one in the art (e.g., UV absorbance, circular dichroism, gel shift, single stranded nuclease sensitivity, etc.). Additionally, conditions under which duplex formation is observed may be varied to determine duplex stability or formation, e.g., temperature, as melting temperature (Tm) correlates with the stability of nucleic acid duplexes. Compared to a reference single stranded nucleic acid that is exactly complementary to a target nucleic acid, the single stranded nucleic acid containing a universal base forms a duplex with the target nucleic acid that has a lower Tm than a duplex formed with the complementary nucleic acid. However, compared to a reference single stranded nucleic acid in which the universal base has been replaced with a base to generate a single mismatch, the single stranded nucleic acid containing the universal base forms a duplex with the target nucleic acid that has a higher Tm than a duplex formed with the nucleic acid having the mismatched base.

Some universal bases are capable of base pairing by forming hydrogen bonds between the universal base and all of the bases guanine (G), cytosine (C), adenine (A), thymine (T), and uracil (U) under base pair forming conditions. A universal base is not a base that forms a base pair with only one single complementary base. In a duplex, a universal base may form no hydrogen bonds, one hydrogen bond, or more than one hydrogen bond with each of G, C, A, T, and U opposite to it on the opposite strand of a duplex. Preferably, the universal bases does not interact with the base opposite to it on the opposite strand of a duplex. In a duplex, base pairing between a universal base occurs without altering the double helical structure of the phosphate backbone. A universal base may also interact with bases in adjacent nucleotides on the same nucleic acid strand by stacking interactions. Such stacking interactions stabilize the duplex, especially in situations where the universal base does not form any hydrogen bonds with the base positioned opposite to it on the opposite strand of the duplex. Non-limiting examples of universal-binding nucleotides include inosine, 1-β-D-ribo furanosyl-5-nitroindole, and/or 1-β-D-ribofuranosyl-3-nitropyrrole (US Pat. Appl. Publ. No. 20070254362 to Quay et al.; Van Aerschot et al., An acyclic 5-nitroindazole nucleoside analogue as ambiguous nucleoside. Nucleic Acids Res. 1995 Nov. 11; 23(21):4363-70; Loakes et al., 3-Nitropyrrole and 5-nitroindole as universal bases in primers for DNA sequencing and PCR. Nucleic Acids Res. 1995 Jul. 11; 23(13):2361-6; Loakes and Brown, 5-Nitroindole as an universal base analogue. Nucleic Acids Res. 1994 Oct. 11; 22(20):4039-43).

As used herein, "loop" refers to a structure formed by a single strand of a nucleic acid, in which complementary regions that flank a particular single stranded nucleotide region hybridize in a way that the single stranded nucleotide region between the complementary regions is excluded from duplex formation or Watson-Crick base pairing. A loop is a single stranded nucleotide region of any length. Examples of loops include the unpaired nucleotides present in such structures as hairpins, stem loops, or extended loops.

As used herein, "extended loop" in the context of a dsRNA refers to a single stranded loop and in addition 1, 2, 3, 4, 5, 6 or up to 20 base pairs or duplexes flanking the loop. In an extended loop, nucleotides that flank the loop on the 5' side form a duplex with nucleotides that flank the loop on the 3' side. An extended loop may form a hairpin or stem loop.

As used herein, "tetraloop" in the context of a dsRNA refers to a loop (a single stranded region) consisting of four nucleotides that forms a stable secondary structure that contributes to the stability of an adjacent Watson-Crick hybridized nucleotides. Without being limited to theory, a tetraloop may stabilize an adjacent Watson-Crick base pair by stacking interactions. In addition, interactions among the four nucleotides in a tetraloop include but are not limited to non-Watson-Crick base pairing, stacking interactions, hydrogen bonding, and contact interactions (Cheong et al., *Nature* 1990 Aug. 16; 346(6285):680-2; Heus and Pardi, *Science* 1991 Jul. 12; 253(5016):191-4). A tetraloop confers an increase in the melting temperature (Tm) of an adjacent duplex that is higher than expected from a simple model loop sequence consisting of four random bases. For example, a tetraloop can confer a melting temperature of at least 55° C. in 10 mM NaHPO$_4$ to a hairpin comprising a duplex of at least 2 base pairs in length. A tetraloop may contain ribonucleotides, deoxyribonucleotides, modified nucleotides, and combinations thereof. Examples of RNA tetraloops include the UNCG family of tetraloops (e.g., UUCG), the GNRA family of tetraloops (e.g., GAAA), and the CUUG tetraloop. (Woese et al., Proc Natl Acad Sci USA. 1990 November; 87(21):8467-71; Antao et al., Nucleic Acids Res. 1991 Nov. 11; 19(21):5901-5). Examples of DNA tetraloops include the d(GNNA) family of tetraloops (e.g., d(GTTA), the d(GNRA)) family of tetraloops, the d(GNAB) family of tetraloops, the d(CNNG) family of tetraloops, the d(TNCG) family of tetraloops (e.g., d(TTCG)). (Nakano et al. Biochemistry, 41 (48), 14281-14292, 2002.; SHINJI et al. Nippon Kagakkai Koen Yokoshu VOL. 78th; NO. 2; PAGE. 731 (2000).)

As used herein, the term "siRNA" refers to a double stranded nucleic acid in which each strand comprises RNA, RNA analog(s) or RNA and DNA. The siRNA comprises between 19 and 23 nucleotides or comprises 21 nucleotides. The siRNA typically has 2 bp overhangs on the 3' ends of each strand such that the duplex region in the siRNA comprises 17-21 nucleotides, or 19 nucleotides. Typically, the antisense strand of the siRNA is sufficiently complementary with the target sequence of the KRAS gene/RNA.

An anti-KRAS DsiRNA of the instant invention possesses strand lengths of at least 25 nucleotides. Accordingly, an anti-KRAS DsiRNA contains one oligonucleotide sequence, a first sequence, that is at least 25 nucleotides in length and no longer thin 35 or up to 50 nucleotides. This sequence of RNA can be between 26 and 35, 26 and 34, 26 and 33, 26 and 32, 26 and 31, 26 and 30, and 26 and 29 nucleotides in length. This sequence can be 27 or 28 nucleotides in length or 27 nucleotides in length. The second sequence of the DsiRNA agent can be a sequence that anneals to the first sequence under biological conditions, such as within the cytoplasm of a eukaryotic cell. Generally, the second oligonucleotide sequence will have at least 19 complementary base pairs with the first oligonucleotide sequence, more typically the second oligonucleotide sequence will have 21 or more complementary base pairs, or 25 or more complementary base pairs with the first oligonucleotide sequence. In one embodiment, the second sequence is the same length as the first sequence, and the DsiRNA agent is blunt ended. In another embodiment, the ends of the DsiRNA agent have one or more overhangs.

In certain embodiments, the first and second oligonucleotide sequences of the DsiRNA agent exist on separate oligonucleotide strands that can be and typically are chemically synthesized. In some embodiments, both strands are between 26 and 35 nucleotides in length. In other embodiments, both strands are between 25 and 30 or 26 and 30 nucleotides in length. In one embodiment, both strands are 27 nucleotides in length, are completely complementary and have blunt ends. In certain embodiments of the instant invention, the first and second sequences of an anti-KRAS DsiRNA exist on separate RNA oligonucleotides (strands). In one embodiment, one or both oligonucleotide strands are capable of serving as a substrate for Dicer. In other embodiments, at least one oligonucleotide is present that promotes Dicer to bind to the double-stranded RNA structure in an orientation that maximizes the double-stranded RNA structure's effectiveness in inhibiting gene expression. In certain embodiments of the instant invention, the anti-KRAS DsiRNA agent is comprised of two oligonucleotide strands of differing lengths, with the anti-KRAS DsiRNA possessing a blunt end at the 3' terminus of a first strand (sense strand) and a 3' overhang at the 3' terminus of a second strand (antisense strand). The DsiRNA can also contain one or more deoxyribonucleic acid (DNA) base substitutions.

Suitable DsiRNA compositions that contain two separate oligonucleotides can be chemically linked outside their annealing region by chemical linking groups. Many suitable chemical linking groups are known in the art and can be used. Suitable groups will not block Dicer activity on the DsiRNA and will not interfere with the directed destruction of the RNA transcribed from the target gene. Alternatively, the two separate oligonucleotides can be linked by a third oligonucleotide such that a hairpin structure is produced upon annealing of the two oligonucleotides making up the DsiRNA composition. The hairpin structure will not block Dicer activity on the DsiRNA and will not interfere with the directed destruction of the target RNA.

As used herein, a dsRNA, e.g., DsiRNA or siRNA, having a sequence "sufficiently complementary" to a target RNA or cDNA sequence (e.g., KRAS mRNA) means that the dsRNA has a sequence sufficient to trigger the destruction of the target RNA (where a cDNA sequence is recited, the RNA sequence corresponding to the recited cDNA sequence) by the RNAi machinery (e.g., the RISC complex) or process. The dsRNA molecule can be designed such that every residue of the antisense strand is complementary to a residue in the target molecule. Alternatively, substitutions can be made within the molecule to increase stability and/or enhance processing activity of said molecule. Substitutions can be made within the strand or can be made to residues at the ends of the strand. In certain embodiments, substitutions and/or modifications are made at specific residues within a DsiRNA agent. Such substitutions and/or modifications can include, e.g., deoxy-modifications at one or more residues of positions 1, 2 and 3 when numbering from the 3' terminal position of the sense strand of a DsiRNA agent; and introduction of 2'-O-alkyl (e.g., 2'-O-methyl) modifications at the 3' terminal residue of the antisense strand of DsiRNA agents, with such modifications also being performed at overhang positions of the 3' portion of the antisense strand and at alternating residues of the antisense strand of the DsiRNA that are included within the region of a DsiRNA agent that is processed to form an active siRNA agent. The preceding modifications are offered as exemplary, and are not intended to be limiting in any manner. Further consideration of the structure of preferred DsiRNA agents, including further description of the modifications and substitutions that can be performed upon the anti-KRAS DsiRNA agents of the instant invention, can be found below.

The phrase "duplex region" refers to the region in two complementary or substantially complementary oligonucleotides that form base pairs with one another, either by Watson-Crick base pairing or other manner that allows for a duplex between oligonucleotide strands that are complementary or substantially complementary. For example, an oligonucleotide strand having 21 nucleotide units can base pair with another oligonucleotide of 21 nucleotide units, yet only 19 bases on each strand are complementary or substantially complementary, such that the "duplex region" consists of 19 base pairs. The remaining base pairs may, for example, exist as 5' and 3' overhangs. Further, within the duplex region, 100% complementarity is not required; substantial complementarity is allowable within a duplex region. Substantial complementarity refers to complementarity between the strands such that they are capable of annealing under biological conditions. Techniques to empirically determine if two strands are capable of annealing under biological conditions are well know in the art. Alternatively, two strands can be synthesized and added together under biological conditions to determine if they anneal to one another.

Single-stranded nucleic acids that base pair over a number of bases are said to "hybridize." Hybridization is typically determined under physiological or biologically relevant conditions (e.g., intracellular: pH 7.2, 140 mM potassium ion; extracellular pH 7.4, 145 mM sodium ion). Hybridization conditions generally contain a monovalent cation and biologically acceptable buffer and may or may not contain a divalent cation, complex anions, e.g. gluconate from potassium gluconate, uncharged species such as sucrose, and inert polymers to reduce the activity of water in the sample, e.g. PEG. Such conditions include conditions under which base pairs can form.

Hybridization is measured by the temperature required to dissociate single stranded nucleic acids forming a duplex, i.e., (the melting temperature; Tm). Hybridization conditions are also conditions under which base pairs can form. Various conditions of stringency can be used to determine hybridization (see, e.g., Wahl, G. M. and S. L. Berger (1987) Methods Enzymol. 152:399; Kimmel, A. R. (1987) Methods Enzymol. 152:507). Stringent temperature conditions will ordinarily include temperatures of at least about 30° C., more preferably of at least about 37° C., and most preferably of at least about 42° C. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, Tm(° C.)=2(# of A+T bases)+4(# of G+C bases). For hybrids between 18 and 49 base pairs in length, Tm(° C.)=81.5+16.6(log 10[Na+])+0.41 (% G+C)−(600/N), where N is the number of bases in the hybrid, and [Na+] is the concentration of sodium ions in the hybridization buffer ([Na+] for 1×SSC=0.165 M). For example, a hybridization determination buffer is shown in Table 1.

TABLE 1

| | final conc. | Vender | Cat# | Lot# | m.w./Stock | To make 50 mL solution |
|---|---|---|---|---|---|---|
| NaCl | 100 mM | Sigma | S-5150 | 41K8934 | 5M | 1 mL |
| KCl | 80 mM | Sigma | P-9541 | 70K0002 | 74.55 | 0.298 g |
| MgCl$_2$ | 8 mM | Sigma | M-1028 | 120K8933 | 1M | 0.4 mL |
| sucrose | 2% w/v | Fisher | BP220-212 | 907105 | 342.3 | 1 g |
| Tris-HCl | 16 mM | Fisher | BP1757-500 | 12419 | 1M | 0.8 mL |
| NaH$_2$PO$_4$ | 1 mM | Sigma | S-3193 | 52H-029515 | 120.0 | 0.006 g |
| EDTA | 0.02 mM | Sigma | E-7889 | 110K89271 | 0.5M | 2 µL |
| H$_2$O | | Sigma | W-4502 | 51K2359 | | to 50 mL |
| pH = 7.0 at 20° C. | | | | adjust with HCl | | |

Useful variations on hybridization conditions will be readily apparent to those skilled in the art. Hybridization techniques are well known to those skilled in the art and are described, for example, in Benton and Davis (Science 196: 180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Antisense to Molecular Cloning Techniques, 1987, Academic Press, New York); and Sambrook et al., Molecular Cloning: A Laboratory Manual, Cold Spring Harbor Laboratory Press, New York.

As used herein, "oligonucleotide strand" is a single stranded nucleic acid molecule. An oligonucleotide may comprise ribonucleotides, deoxyribonucleotides, modified nucleotides (e.g., nucleotides with 2' modifications, synthetic base analogs, etc.) or combinations thereof. Such modified oligonucleotides can be preferred over native forms because of properties such as, for example, enhanced cellular uptake and increased stability in the presence of nucleases.

As used herein, the term "ribonucleotide" encompasses natural and synthetic, unmodified and modified ribonucleotides. Modifications include changes to the sugar moiety, to the base moiety and/or to the linkages between ribonucleotides in the oligonucleotide. As used herein, the term "ribonucleotide" specifically excludes a deoxyribonucleotide, which is a nucleotide possessing a single proton group at the 2' ribose ring position.

As used herein, the term "deoxyribonucleotide" encompasses natural and synthetic, unmodified and modified deoxyribonucleotides. Modifications include changes to the sugar moiety, to the base moiety and/or to the linkages between deoxyribonucleotide in the oligonucleotide. As used herein, the term "deoxyribonucleotide" also includes a modified ribonucleotide that does not permit Dicer cleavage of a dsRNA agent, e.g., a 2'-O-methyl ribonucleotide, a phosphorothioate-modified ribonucleotide residue, etc., that does not permit Dicer cleavage to occur at a bond of such a residue.

As used herein, the term "PS-NA" refers to a phosphorothioate-modified nucleotide residue. The term "PS-NA" therefore encompasses both phosphorothioate-modified ribonucleotides ("PS-RNAs") and phosphorothioate-modified deoxyriibonucleotides ("PS-DNAs").

As used herein, "Dicer" refers to an endoribonuclease in the RNase III family that cleaves a dsRNA or dsRNA-containing molecule, e.g., double-stranded RNA (dsRNA) or pre-microRNA (miRNA), into double-stranded nucleic acid fragments 19-25 nucleotides long, usually with a two-base overhang on the 3' end. With respect to the dsRNAs of the invention, the duplex formed by a dsRNA region of an agent of the invention is recognized by Dicer and is a Dicer substrate on at least one strand of the duplex. Dicer catalyzes the first step in the RNA interference pathway, which consequently results in the degradation of a target RNA. The protein sequence of human Dicer is provided at the NCBI database under accession number NP_085124, hereby incorporated by reference.

Dicer "cleavage" is determined as follows (e.g., see Collingwood et al., Oligonucleotides 18:187-200 (2008)). In a Dicer cleavage assay, RNA duplexes (100 pmol) are incubated in 20 µL of 20 mM Tris pH 8.0, 200 mM NaCl, 2.5 mM MgCl2 with or without 1 unit of recombinant human Dicer (Stratagene, La Jolla, Calif.) at 37° C. for 18-24 hours. Samples are desalted using a Performa SR 96-well plate (Edge Biosystems, Gaithersburg, Md.). Electrospray-ionization liquid chromatography mass spectroscopy (ESI-LCMS) of duplex RNAs pre- and post-treatment with Dicer is done using an Oligo HTCS system (Novatia, Princeton, N.J.; Hail et al., 2004), which consists of a ThermoFinnigan TSQ7000, Xcalibur data system, ProMass data processing software and Paradigm MS4 HPLC (Michrom BioResources, Auburn, Calif.). In this assay, Dicer cleavage occurs where at least 5%, 10%, 20%, 30%, 40%, 50%, 60%, 70%, 80%, 90%, 95%, or even 100% of the Dicer substrate dsRNA, (i.e., 25-30 bp dsRNA, preferably 26-30 bp dsRNA) is cleaved to a shorter dsRNA (e.g., 19-23 bp dsRNA, preferably, 21-23 bp dsRNA).

As used herein, "Dicer cleavage site" refers to the sites at which Dicer cleaves a dsRNA (e.g., the dsRNA region of a DsiRNA agent of the invention). Dicer contains two RNase III domains which typically cleave both the sense and antisense strands of a dsRNA. The average distance between the RNase III domains and the PAZ domain determines the length of the short double-stranded nucleic acid fragments it produces and this distance can vary (Macrae I, et al. (2006). "Structural basis for double-stranded RNA processing by Dicer". Science 311 (5758): 195-8.). As shown in FIGS. 1 and 4, Dicer is projected to cleave certain double-stranded ribonucleic acids of the instant invention that possess an antisense strand having a 2 nucleotide 3' overhang at a site between the $21^{st}$ and $22^{nd}$ nucleotides removed from the 3' terminus of the antisense strand, and at a corresponding site between the $21^{st}$ and $22^{nd}$ nucleotides removed from the 5' terminus of the sense strand. The projected and/or prevalent Dicer cleavage site(s) for dsRNA molecules distinct from those depicted in FIGS. 1 and 4 may be similarly identified via art-recognized methods, including those described in Macrae et al. While the Dicer cleavage events depicted in FIGS. 1 and 4 generate 21 nucleotide siRNAs, it is noted that Dicer cleavage of a dsRNA (e.g., DsiRNA) can result in generation of Dicer-processed siRNA lengths of 19 to 23 nucleotides in length. Indeed, in certain embodiments, a double-stranded DNA region may be included within a dsRNA for purpose of directing prevalent Dicer excision of a typically non-preferred 19mer or 20mer siRNA, rather than a 21mer.

As used herein, "overhang" refers to unpaired nucleotides, in the context of a duplex having one or more free ends at the 5' terminus or 3' terminus of a dsRNA. In certain embodiments, the overhang is a 3' or 5' overhang on the antisense strand or sense strand. In some embodiments, the overhang is a 3' overhang having a length of between one and six nucleotides, optionally one to five, one to four, one to three, one to two, two to six, two to five, two to four, two to three, three to six, three to five, three to four, four to six, four to five, five to six nucleotides, or one, two, three, four, five or six nucleotides.

As used herein, the term "RNA processing" refers to processing activities performed by components of the siRNA, miRNA or RNase H pathways (e.g., Drosha, Dicer, Argonaute2 or other RISC endoribonucleases, and RNaseH), which are described in greater detail below (see "RNA Processing" section below). The term is explicitly distinguished from the post-transcriptional processes of 5' capping of RNA and degradation of RNA via non-RISC- or non-RNase H-mediated processes. Such "degradation" of an RNA can take several forms, e.g. deadenylation (removal of a 3' poly(A) tail), and/or nuclease digestion of part or all of the body of the RNA by one or more of several endo- or exo-nucleases (e.g., RNase III, RNase P, RNase T1, RNase A (1, 2, 3, 4/5), oligonucleotidase, etc.).

By "homologous sequence" is meant, a nucleotide sequence that is shared by one or more polynucleotide sequences, such as genes, gene transcripts and/or non-coding polynucleotides. For example, a homologous sequence can be a nucleotide sequence that is shared by two or more genes encoding related but different proteins, such as different members of a gene family, different protein epitopes, different protein isoforms or completely divergent genes, such as a cytokine and its corresponding receptors. A homologous sequence can be a nucleotide sequence that is shared by two or more non-coding polynucleotides, such as noncoding DNA or RNA, regulatory sequences, introns, and sites of transcriptional control or regulation. Homologous sequences can also include conserved sequence regions shared by more than one polynucleotide sequence. Homology does not need to be perfect homology (e.g., 100%), as partially homologous sequences are also contemplated by the instant invention (e.g., 99%, 98%, 97%, 96%, 95%, 94%, 93%, 92%, 91%, 90%, 89%, 88%, 87%, 86%, 85%, 84%, 83%, 82%, 81%, 80% etc.). Indeed, design and use of the DsiRNA agents of the instant invention contemplates the possibility of using such DsiRNA agents not only against target RNAs of KRAS possessing perfect complementarity with the presently described DsiRNA agents, but also against target KRAS RNAs possessing sequences that are, e.g., only 99%, 98%, 97%, 96%, 95%, 94%, 93%, 92%, 91%, 90%, 89%, 88%, 87%, 86%, 85%, 84%, 83%, 82%, 81%, 80% etc. complementary to said DsiRNA agents. Similarly, it is contemplated that the presently described DsiRNA agents of the instant invention might be readily altered by the skilled artisan to enhance the extent of complementarity between said DsiRNA agents and a target KRAS RNA, e.g., of a specific allelic variant of KRAS (e.g., an allele of enhanced therapeutic interest). Indeed, DsiRNA agent sequences with insertions, deletions, and single point mutations relative to the target KRAS sequence can also be effective for inhibition. Alternatively, DsiRNA agent sequences with nucleotide analog substitutions or insertions can be effective for inhibition.

Sequence identity may be determined by sequence comparison and alignment algorithms known in the art. To determine the percent identity of two nucleic acid sequences (or of two amino acid sequences), the sequences are aligned for optimal comparison purposes (e.g., gaps can be introduced in the first sequence or second sequence for optimal alignment). The nucleotides (or amino acid residues) at corresponding nucleotide (or amino acid) positions are then compared. When a position in the first sequence is occupied by the same residue as the corresponding position in the second sequence, then the molecules are identical at that position. The percent identity between the two sequences is a function of the number of identical positions shared by the sequences (i.e., % homology=# of identical positions/total # of positions.times.100), optionally penalizing the score for the number of gaps introduced and/or length of gaps introduced.

The comparison of sequences and determination of percent identity between two sequences can be accomplished using a mathematical algorithm. In one embodiment, the alignment generated over a certain portion of the sequence aligned having sufficient identity but not over portions having low degree of identity (i.e., a local alignment). A preferred, non-limiting example of a local alignment algorithm utilized for the comparison of sequences is the algorithm of Karlin and Altschul (1990) Proc. Natl. Acad. Sci. USA 87:2264-68, modified as in Karlin and Altschul (1993) Proc. Natl. Acad. Sci. USA 90:5873-77. Such an algorithm is incorporated into the BLAST programs (version 2.0) of Altschul, et al. (1990) J. Mol. Biol. 215:403-10.

In another embodiment, the alignment is optimized by introducing appropriate gaps and percent identity is determined over the length of the aligned sequences (i.e., a gapped alignment). To obtain gapped alignments for comparison purposes, Gapped BLAST can be utilized as described in Altschul et al., (1997) Nucleic Acids Res. 25(17):3389-3402. In another embodiment, the alignment is optimized by introducing appropriate gaps and percent identity is determined over the entire length of the sequences aligned (i.e., a global alignment). A preferred, non-limiting example of a mathematical algorithm utilized for the global comparison of sequences is the algorithm of Myers and Miller, CABIOS (1989). Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used.

Greater than 80% sequence identity, e.g., 80%, 81%, 82%, 83%, 84%, 85%, 86%, 87%, 88%, 89%, 90%, 91%, 92%, 93%, 94%, 95%, 96%, 97%, 98%, 99% or even 100% sequence identity, between the DsiRNA antisense strand and the portion of the KRAS RNA sequence is preferred. Alternatively, the DsiRNA may be defined functionally as a nucleotide sequence (or oligonucleotide sequence) that is capable of hybridizing with a portion of the KRAS RNA (e.g., 400 mM NaCl, 40 mM PIPES pH 6.4, 1 mM EDTA, 50° C. or 70° C. hybridization for 12-16 hours; followed by washing). Additional preferred hybridization conditions include hybridization at 70° C. in 1×SSC or 50° C. in 1×SSC, 50% formamide followed by washing at 70° C. in 0.3×SSC or hybridization at 70° C. in 4×SSC or 50° C. in 4×SSC, 50% formamide followed by washing at 67° C. in 1×SSC. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, Tm(° C.)=2(# of A+T bases)+4(# of G+C bases). For hybrids between 18 and 49 base pairs in length, Tm(° C.)=81.5+16.6(log 10[Na+])+0.41 (% G+C)−(600/N), where N is the number of bases in the hybrid, and [Na+] is the concentration of sodium ions in the hybridization buffer ([Na+] for 1×SSC=0.165 M). Additional examples of stringency conditions for polynucleotide hybridization are provided in Sambrook, J., E. F. Fritsch, and T. Maniatis, 1989, Molecular Cloning: A Laboratory Manual, Cold Spring Harbor Laboratory Press, Cold Spring Harbor, N.Y., chapters 9 and 11, and Current Protocols in Molecular Biology, 1995, F. M. Ausubel et al., eds., John Wiley & Sons, Inc., sections 2.10 and 6.3-6.4. The length of the identical nucleotide sequences may be at least 10, 12, 15, 17, 20, 22, 25, 27 or 30 bases.

By "conserved sequence region" is meant, a nucleotide sequence of one or more regions in a polynucleotide does not vary significantly between generations or from one biological system, subject, or organism to another biological system, subject, or organism. The polynucleotide can include both coding and non-coding DNA and RNA.

By "sense region" is meant a nucleotide sequence of a DsiRNA molecule having complementarity to an antisense region of the DsiRNA molecule. In addition, the sense region of a DsiRNA molecule can comprise a nucleic acid sequence having homology with a target nucleic acid sequence.

By "antisense region" is meant a nucleotide sequence of a DsiRNA molecule having complementarity to a target nucleic acid sequence. In addition, the antisense region of a DsiRNA molecule comprises a nucleic acid sequence having complementarity to a sense region of the DsiRNA molecule.

As used herein, "antisense strand" refers to a single stranded nucleic acid molecule which has a sequence complementary to that of a target RNA. When the antisense strand contains modified nucleotides with base analogs, it is not necessarily complementary over its entire length, but must at least hybridize with a target RNA.

As used herein, "sense strand" refers to a single stranded nucleic acid molecule which has a sequence complementary to that of an antisense strand. When the antisense strand contains modified nucleotides with base analogs, the sense strand need not be complementary over the entire length of the antisense strand, but must at least duplex with the antisense strand.

As used herein, "guide strand" refers to a single stranded nucleic acid molecule of a dsRNA or dsRNA-containing molecule, which has a sequence sufficiently complementary to that of a target RNA to result in RNA interference. After cleavage of the dsRNA or dsRNA-containing molecule by Dicer, a fragment of the guide strand remains associated with RISC, binds a target RNA as a component of the RISC complex, and promotes cleavage of a target RNA by RISC. As used herein, the guide strand does not necessarily refer to a continuous single stranded nucleic acid and may comprise a discontinuity, preferably at a site that is cleaved by Dicer. A guide strand is an antisense strand.

As used herein, "passenger strand" refers to an oligonucleotide strand of a dsRNA or dsRNA-containing molecule, which has a sequence that is complementary to that of the guide strand. As used herein, the passenger strand does not necessarily refer to a continuous single stranded nucleic acid and may comprise a discontinuity, preferably at a site that is cleaved by Dicer. A passenger strand is a sense strand.

By "target nucleic acid" is meant a nucleic acid sequence whose expression, level or activity is to be modulated. The target nucleic acid can be DNA or RNA. For agents that target KRAS, in certain embodiments target nucleic acid is KRAS RNA. KRAS RNA target sites can also interchangeably be referenced by corresponding cDNA sequences. Levels of KRAS may also be targeted via targeting of upstream effectors of KRAS, or the effects of modulated or misregulated KRAS may also be modulated by targeting of molecules downstream of KRAS in the Ras signalling pathway.

By "complementarity" is meant that a nucleic acid can form hydrogen bond(s) with another nucleic acid sequence by either traditional Watson-Crick or other non-traditional types. In reference to the nucleic molecules of the present invention, the binding free energy for a nucleic acid molecule with its complementary sequence is sufficient to allow the relevant function of the nucleic acid to proceed, e.g., RNAi activity. Determination of binding free energies for nucleic acid molecules is well known in the art (see, e.g., Turner et al., 1987, CSH Symp. Quant. Biol. LII pp. 123-133; Frier et al., 1986, Proc. Nat. Acad. Sci. USA 83:9373-9377; Turner et al., 1987, J. Am. Chem. Soc. 109:3783-3785). A percent complementarity indicates the percentage of contiguous residues in a nucleic acid molecule that can form hydrogen bonds (e.g., Watson-Crick base pairing) with a second nucleic acid sequence (e.g., 5, 6, 7, 8, 9, or 10 nucleotides out of a total of 10 nucleotides in the first oligonucleotide being based paired to a second nucleic acid sequence having 10 nucleotides represents 50%, 60%, 70%, 80%, 90%, and 100% complementary respectively). "Perfectly complementary" means that all the contiguous residues of a nucleic acid sequence will hydrogen bond with the same number of contiguous residues in a second nucleic acid sequence. In one embodiment, a DsiRNA molecule of the invention comprises 19 to 30 (e.g., 19, 20, 21, 22, 23, 24, 25, 26, 27, 28, 29, or 30 or more) nucleotides that are complementary to one or more target nucleic acid molecules or a portion thereof.

In one embodiment, DsiRNA molecules of the invention that down regulate or reduce KRAS gene expression are used for treating, preventing or reducing KRAS-related diseases or disorders (e.g., cancer) in a subject or organism.

In one embodiment of the present invention, each sequence of a DsiRNA molecule of the invention is independently 25 to 35 nucleotides in length, in specific embodiments 25, 26, 27, 28, 29, 30, 31, 32, 33, 34 or 35 nucleotides in length. In another embodiment, the DsiRNA duplexes of the invention independently comprise 25 to 30 base pairs (e.g., 25, 26, 27, 28, 29, or 30). In another embodiment, one or more strands of the DsiRNA molecule of the invention independently comprises 19 to 35 nucleotides (e.g., 19, 20, 21, 22, 23, 24, 25, 26, 27, 28, 29, 30, 31, 32, 33, 34 or 35) that are complementary to a target (KRAS) nucleic acid molecule. In certain embodiments, a DsiRNA molecule of the invention possesses a length of duplexed nucleotides between 25 and 34 nucleotides in length (e.g., 25, 26, 27, 28, 29, 30, 31, 32, 33 or 34 nucleotides in length; optionally, all such nucleotides base pair with cognate nucleotides of the opposite strand). (Exemplary DsiRNA molecules of the invention are shown in FIGS. 1 and 4, and below.

As used herein "cell" is used in its usual biological sense, and does not refer to an entire multicellular organism, e.g., specifically does not refer to a human. The cell can be present in an organism, e.g., birds, plants and mammals such as humans, cows, sheep, apes, monkeys, swine, dogs, and cats. The cell can be prokaryotic (e.g., bacterial cell) or eukaryotic (e.g., mammalian or plant cell). The cell can be of somatic or germ line origin, totipotent or pluripotent, dividing or non-dividing. The cell can also be derived from or can comprise a gamete or embryo, a stem cell, or a fully differentiated cell. Within certain aspects, the term "cell" refers specifically to mammalian cells, such as human cells, that contain one or more isolated dsRNA molecules of the present disclosure. In particular aspects, a cell processes dsRNAs or dsRNA-containing molecules resulting in RNA intereference of target nucleic acids, and contains proteins and protein complexes required for RNAi, e.g., Dicer and RISC.

The DsiRNA molecules of the invention are added directly, or can be complexed with cationic lipids, packaged within liposomes, or otherwise delivered to target cells or tissues. The nucleic acid or nucleic acid complexes can be locally administered to relevant tissues ex vivo, or in vivo through direct dermal application, transdermal application, or injection, with or without their incorporation in biopolymers. In particular embodiments, the nucleic acid molecules of the invention comprise sequences shown in FIGS. 1 and 4, and the below exemplary structures. Examples of such nucleic acid molecules consist essentially of sequences defined in these figures and exemplary structures. Furthermore, where such agents are modified in accordance with the below description of modification patterning of DsiRNA agents, chemically modified forms of constructs described in FIGS. 1 and 4, and the below exemplary structures can be used in all uses described for the DsiRNA agents of FIGS. 1 and 4, and the below exemplary structures.

In another aspect, the invention provides mammalian cells containing one or more DsiRNA molecules of this invention. The one or more DsiRNA molecules can independently be targeted to the same or different sites.

By "RNA" is meant a molecule comprising at least one ribonucleotide residue. By "ribonucleotide" is meant a nucleotide with a hydroxyl group at the 2' position of a β-D-ribofuranose moiety. The terms include double-stranded RNA, single-stranded RNA, isolated RNA such as partially purified RNA, essentially pure RNA, synthetic RNA, recombinantly produced RNA, as well as altered RNA that differs from naturally occurring RNA by the addition, deletion, substitution and/or alteration of one or more nucleotides. Such alterations can include addition of non-nucleotide material, such as to the end(s) of the DsiRNA or internally, for example at one or more nucleotides of the RNA. Nucleotides in the RNA molecules of the instant invention can also comprise non-standard nucleotides, such as non-naturally occurring nucleotides or chemically synthesized nucleotides or deoxynucleotides. These altered RNAs can be referred to as analogs or analogs of naturally-occurring RNA.

By "subject" is meant an organism, which is a donor or recipient of explanted cells or the cells themselves. "Subject" also refers to an organism to which the DsiRNA agents of the invention can be administered. A subject can be a mammal or mammalian cells, including a human or human cells.

The phrase "pharmaceutically acceptable carrier" refers to a carrier for the administration of a therapeutic agent. Exemplary carriers include saline, buffered saline, dextrose, water, glycerol, ethanol, and combinations thereof. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract. The pharmaceutically acceptable carrier of the disclosed dsRNA compositions may be micellar structures, such as a liposomes, capsids, capsoids, polymeric nanocapsules, or polymeric microcapsules.

Polymeric nanocapsules or microcapsules facilitate transport and release of the encapsulated or bound dsRNA into the cell. They include polymeric and monomeric materials, especially including polybutylcyanoacrylate. A summary of materials and fabrication methods has been published (see Kreuter, 1991). The polymeric materials which are formed from monomeric and/or oligomeric precursors in the polymerization/nanoparticle generation step, are per se known from the prior art, as are the molecular weights and molecular weight distribution of the polymeric material which a person skilled in the field of manufacturing nanoparticles may suitably select in accordance with the usual skill.

Various methodologies of the instant invention include step that involves comparing a value, level, feature, characteristic, property, etc. to a "suitable control", referred to interchangeably herein as an "appropriate control". A "suitable control" or "appropriate control" is a control or standard familiar to one of ordinary skill in the art useful for comparison purposes. In one embodiment, a "suitable control" or "appropriate control" is a value, level, feature, characteristic, property, etc. determined prior to performing an RNAi methodology, as described herein. For example, a transcription rate, mRNA level, translation rate, protein level, biological activity, cellular characteristic or property, genotype, phenotype, etc. can be determined prior to introducing an RNA silencing agent (e.g., DsiRNA) of the invention into a cell or organism. In another embodiment, a "suitable control" or "appropriate control" is a value, level, feature, characteristic, property, etc. determined in a cell or organism, e.g., a control or normal cell or organism, exhibiting, for example, normal traits. In yet another embodiment, a "suitable control" or "appropriate control" is a predefined value, level, feature, characteristic, property, etc.

The term "in vitro" has its art recognized meaning, e.g., involving purified reagents or extracts, e.g., cell extracts. The term "in vivo" also has its art recognized meaning, e.g., involving living cells, e.g., immortalized cells, primary cells, cell lines, and/or cells in an organism.

"Treatment", or "treating" as used herein, is defined as the application or administration of a therapeutic agent (e.g., a DsiRNA agent or a vector or transgene encoding same) to a patient, or application or administration of a therapeutic agent to an isolated tissue or cell line from a patient, who has a disorder with the purpose to cure, heal, alleviate, relieve, alter, remedy, ameliorate, improve or affect the disease or disorder, or symptoms of the disease or disorder. The term "treatment" or "treating" is also used herein in the context of administering agents prophylactically. The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. The term "patient" includes human and other mammalian subjects that receive either prophylactic or therapeutic treatment.

Structures of Anti-KRAS DsiRNA Agents

In certain embodiments, the anti-KRAS DsiRNA agents of the invention can have the following structures:

In one such embodiment, the DsiRNA comprises:

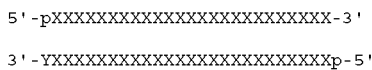

wherein "X"=RNA, "p"=a phosphate group and "Y" is an overhang domain comprised of 1-4 RNA monomers that are optionally 2'-O-methyl RNA monomers. In a related embodiment, the DsiRNA comprises:

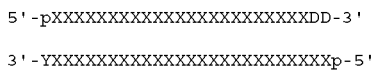

wherein "X"=RNA, "p"=a phosphate group, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the antisense strand.

In an additional embodiment, the DsiRNA comprises:

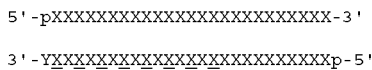

wherein "X"=RNA, "p"=a phosphate group, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

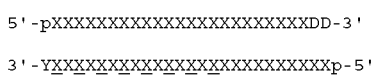

wherein "X"=RNA, "p"=a phosphate group, "X"=2'-O-methyl RNA, "Y" is an overhang domain comprised of 1-4 RNA monomers that are optionally 2'-O-methyl RNA monomers and underlined residues are 2'-O-methyl RNA monomers, and "D"=DNA. The top strand is the sense strand, and the bottom strand is the antisense strand.

In another such embodiment, the DsiRNA comprises:

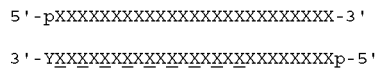

wherein "X"=RNA, "p"=a phosphate group, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

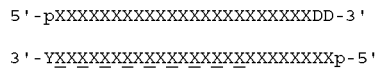

wherein "X"=RNA, "p"=a phosphate group, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand.

In another such embodiment, the DsiRNA comprises:

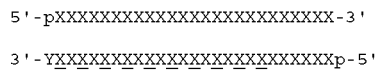

wherein "X"=RNA, "p"=a phosphate group, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

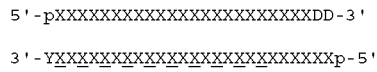

wherein "X"=RNA, "p"=a phosphate group, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand.

In further embodiments, the DsiRNA comprises:

wherein "X"=RNA, "p"=a phosphate group, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-pXXXXXXXXXXXXXXXXXXXXXXXXXDD-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

```
5'-pXXXXXXXXXXXXXXXXXXXXXXXXX-3'
3'-XXXXXXXXXXXXXXXXXXXXXXXXXXXp-5'
``` wherein "X"=RNA, "p"=a phosphate group and "X"=2'-O-methyl RNA. In a further related embodiment, the DsiRNA comprises:

```
5'-pXXXXXXXXXXXXXXXXXXXXXXXXXDD-3'
3'-XXXXXXXXXXXXXXXXXXXXXXXXXXXp-5'
``` wherein "X"=RNA, "p"=a phosphate group, "X"=2'-O-methyl RNA, and "D"=DNA. The top strand is the sense strand, and the bottom strand is the antisense strand.

In additional embodiments, the DsiRNA comprises:

```
5'-pXXXXXXXXXXXXXXXXXXXXXXXXX-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-pXXXXXXXXXXXXXXXXXXXXXXXXXDD-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. The top strand is the sense strand, and the bottom strand is the antisense strand. In another related embodiment, the DsiRNA comprises:

```
5'-pXXXXXXXXXXXXXXXXXXXXXXXXX-3'
3'-XXXXXXXXXXXXXXXXXXXXXXXXXXXp-5'
``` wherein "X"=RNA, "p"=a phosphate group and "X"=2'-O-methyl RNA. The top strand is the sense strand, and the bottom strand is the antisense strand. In a further related embodiment, the DsiRNA comprises:

```
5'-pXXXXXXXXXXXXXXXXXXXXXXXXXDD-3'
3'-XXXXXXXXXXXXXXXXXXXXXXXXXXXp-5'
``` wherein "X"=RNA, "p"=a phosphate group, "X"=2'-O-methyl RNA, and "D"=DNA. The top strand is the sense strand, and the bottom strand is the antisense strand.

In other embodiments, the DsiRNA comprises:

```
5'-pXXXXXXXXXXXXXXXXXXXXXXXXX-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-pXXXXXXXXXXXXXXXXXXXXXXXXXDD-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

```
5'-pXXXXXXXXXXXXXXXXXXXXXXXXX-3'
3'-XXXXXXXXXXXXXXXXXXXXXXXXXXXp-5'
``` wherein "X"=RNA, "p"=a phosphate group and "X"=2'-O-methyl RNA. The top strand is the sense strand, and the bottom strand is the antisense strand. In another related embodiment, the DsiRNA comprises:

```
5'-pXXXXXXXXXXXXXXXXXXXXXXXXXDD-3'
3'-XXXXXXXXXXXXXXXXXXXXXXXXXXXp-5'
``` wherein "X"=RNA, "p"=a phosphate group, "X"=2'-O-methyl RNA, and "D"=DNA. The top strand is the sense strand, and the bottom strand is the antisense strand.

In further embodiments, the DsiRNA comprises:

```
5'-pXXXXXXXXXXXXXXXXXXXXXXXXX-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-pXXXXXXXXXXXXXXXXXXXXXXXXXDD-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

```
5'-pXXXXXXXXXXXXXXXXXXXXXXXXX-3'
3'-XXXXXXXXXXXXXXXXXXXXXXXXXXXp-5'
``` wherein "X"=RNA, "p"=a phosphate group and "X"=2'-O-methyl RNA. The top strand is the sense strand, and the bottom strand is the antisense strand. In a further related embodiment, the DsiRNA comprises:

```
5'-pXXXXXXXXXXXXXXXXXXXXXXXDD-3'
3'-XXXXXXXXXXXXXXXXXXXXXXXXXXXp-5'
``` wherein "X"=RNA, "p"=a phosphate group, "X"=2'-O-methyl RNA, and "D"=DNA. The top strand is the sense strand, and the bottom strand is the antisense strand.

In additional embodiments, the DsiRNA comprises:

```
5'-pXXXXXXXXXXXXXXXXXXXXXXXXX-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-pXXXXXXXXXXXXXXXXXXXXXXXDD-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-pXXXXXXXXXXXXXXXXXXXXXXXXX-3'
3'-XXXXXXXXXXXXXXXXXXXXXXXXXXXp-5'
``` wherein "X"=RNA, "p"=a phosphate group and "X"=2'-O-methyl RNA. The top strand is the sense strand, and the bottom strand is the antisense strand. In a further related embodiment, the DsiRNA comprises:

```
5'-pXXXXXXXXXXXXXXXXXXXXXXXDD-3'
3'-XXXXXXXXXXXXXXXXXXXXXXXXXXXp-5'
``` wherein "X"=RNA, "p"=a phosphate group, "X"=2'-O-methyl RNA, and "D"=DNA. The top strand is the sense strand, and the bottom strand is the antisense strand.

In other embodiments, the DsiRNA comprises:

```
5'-pXXXXXXXXXXXXXXXXXXXXXXXXX-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-pXXXXXXXXXXXXXXXXXXXXXXXDD-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-pXXXXXXXXXXXXXXXXXXXXXXXXX-3'
3'-XXXXXXXXXXXXXXXXXXXXXXXXXXXp-5'
``` wherein "X"=RNA, "p"=a phosphate group and "X"=2'-O-methyl RNA. The top strand is the sense strand, and the bottom strand is the antisense strand. In a further related embodiment, the DsiRNA comprises:

```
5'-pXXXXXXXXXXXXXXXXXXXXXXXDD-3'
3'-XXXXXXXXXXXXXXXXXXXXXXXXXXXp-5'
``` wherein "X"=RNA, "p"=a phosphate group, "X"=2'-O-methyl RNA, and "D"=DNA. The top strand is the sense strand, and the bottom strand is the antisense strand.

In additional embodiments, the DsiRNA comprises:

```
5'-pXXXXXXXXXXXXXXXXXXXXXXXXX-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-pXXXXXXXXXXXXXXXXXXXXXXXDD-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-pXXXXXXXXXXXXXXXXXXXXXXXXX-3'
3'-XXXXXXXXXXXXXXXXXXXXXXXXXXXp-5'
``` wherein "X"=RNA, "p"=a phosphate group and "X"=2'-O-methyl RNA. The top strand is the sense strand, and the bottom strand is the antisense strand. In a further related embodiment, the DsiRNA comprises:

```
5'-pXXXXXXXXXXXXXXXXXXXXXXXXXDD-3'
3'-XXXXXXXXXXXXXXXXXXXXXXXXXXXXp-5'
``` wherein "X"=RNA, "p"=a phosphate group, "X"=2'-O-methyl RNA, and "D"=DNA. The top strand is the sense strand, and the bottom strand is the antisense strand.

In further embodiments, the DsiRNA comprises:

```
5'-pXXXXXXXXXXXXXXXXXXXXXXXXX-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-pXXXXXXXXXXXXXXXXXXXXXXXXXDD-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-pXXXXXXXXXXXXXXXXXXXXXXXXX-3'
3'-XXXXXXXXXXXXXXXXXXXXXXXXXXXXp-5'
``` wherein "X"=RNA, "p"=a phosphate group and "X"=2'-O-methyl RNA. The top strand is the sense strand, and the bottom strand is the antisense strand. In a further related embodiment, the DsiRNA comprises:

```
5'-pXXXXXXXXXXXXXXXXXXXXXXXXXDD-3'
3'-XXXXXXXXXXXXXXXXXXXXXXXXXXXXp-5'
``` wherein "X"=RNA, "p"=a phosphate group, "X"=2'-O-methyl RNA, and "D"=DNA. The top strand is the sense strand, and the bottom strand is the antisense strand.

In additional embodiments, the DsiRNA comprises:

```
5'-pXXXXXXXXXXXXXXXXXXXXXXXXX-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-pXXXXXXXXXXXXXXXXXXXXXXXXXDD-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-pXXXXXXXXXXXXXXXXXXXXXXXXX-3'
3'-XXXXXXXXXXXXXXXXXXXXXXXXXXXXp-5'
``` wherein "X"=RNA, "p"=a phosphate group and "X"=2'-O-methyl RNA. The top strand is the sense strand, and the bottom strand is the antisense strand. In a further related embodiment, the DsiRNA comprises:

```
5'-pXXXXXXXXXXXXXXXXXXXXXXXXXDD-3'
3'-XXXXXXXXXXXXXXXXXXXXXXXXXXXXp-5'
``` wherein "X"=RNA, "p"=a phosphate group, "X"=2'-O-methyl RNA, and "D"=DNA. The top strand is the sense strand, and the bottom strand is the antisense strand.

In other embodiments, the DsiRNA comprises:

```
5'-pXXXXXXXXXXXXXXXXXXXXXXXXX-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-pXXXXXXXXXXXXXXXXXXXXXXXXXDD-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-pXXXXXXXXXXXXXXXXXXXXXXXXX-3'
3'-XXXXXXXXXXXXXXXXXXXXXXXXXXXXp-5'
``` wherein "X"=RNA, "p"=a phosphate group and "X"=2'-O-methyl RNA. The top strand is the sense strand, and the bottom strand is the antisense strand. In a further related embodiment, the DsiRNA comprises:

```
5'-pXXXXXXXXXXXXXXXXXXXXXXXXXDD-3'
3'-XXXXXXXXXXXXXXXXXXXXXXXXXXXXp-5'
``` wherein "X"=RNA, "p"=a phosphate group, "X"=2'-O-methyl RNA, and "D"=DNA. The top strand is the sense strand, and the bottom strand is the antisense strand.

In further embodiments, the DsiRNA comprises:

```
5'-pXXXXXXXXXXXXXXXXXXXXXXXXX-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-pXXXXXXXXXXXXXXXXXXXXXXXDD-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-pXXXXXXXXXXXXXXXXXXXXXXXXX-3'
3'-XXXXXXXXXXXXXXXXXXXXXXXXXXXXp-5'
``` wherein "X"=RNA, "p"=a phosphate group and "X"=2'-O-methyl RNA. The top strand is the sense strand, and the bottom strand is the antisense strand. In a further related embodiment, the DsiRNA comprises:

```
5'-pXXXXXXXXXXXXXXXXXXXXXXXDD-3'
3'-XXXXXXXXXXXXXXXXXXXXXXXXXXXXp-5'
``` wherein "X"=RNA, "p"=a phosphate group, "X"=2'-O-methyl RNA, and "D"=DNA. The top strand is the sense strand, and the bottom strand is the antisense strand.

In additional embodiments, the DsiRNA comprises:

```
5'-pXXXXXXXXXXXXXXXXXXXXXXXXX-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-pXXXXXXXXXXXXXXXXXXXXXXXDD-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-pXXXXXXXXXXXXXXXXXXXXXXXXX-3'
3'-XXXXXXXXXXXXXXXXXXXXXXXXXXXXp-5'
``` wherein "X"=RNA, "p"=a phosphate group and "X"=2'-O-methyl RNA. The top strand is the sense strand, and the bottom strand is the antisense strand. In a further related embodiment, the DsiRNA comprises:

```
5'-pXXXXXXXXXXXXXXXXXXXXXXXDD-3'
3'-XXXXXXXXXXXXXXXXXXXXXXXXXXXXp-5'
``` wherein "X"=RNA, "p"=a phosphate group, "X"=2'-O-methyl RNA, and "D"=DNA. The top strand is the sense strand, and the bottom strand is the antisense strand.

In further embodiments, the DsiRNA comprises:

```
5'-pXXXXXXXXXXXXXXXXXXXXXXXXX-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-pXXXXXXXXXXXXXXXXXXXXXXXDD-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-pXXXXXXXXXXXXXXXXXXXXXXXXX-3'
3'-XXXXXXXXXXXXXXXXXXXXXXXXXXXXp-5'
``` wherein "X"=RNA, "p"=a phosphate group and "X"=2'-O-methyl RNA. The top strand is the sense strand, and the bottom strand is the antisense strand. In a further related embodiment, the DsiRNA comprises:

```
5'-pXXXXXXXXXXXXXXXXXXXXXXXDD-3'
3'-XXXXXXXXXXXXXXXXXXXXXXXXXXXXp-5'
``` wherein "X"=RNA, "p"=a phosphate group, "X"=2'-O-methyl RNA, and "D"=DNA. The top strand is the sense strand, and the bottom strand is the antisense strand.

In other embodiments, the DsiRNA comprises:

```
5'-pXXXXXXXXXXXXXXXXXXXXXXXXX-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In another related embodiment, the DsiRNA comprises:

```
5'-pXXXXXXXXXXXXXXXXXXXXXXXXXDD-3'
3'-YXXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-pXXXXXXXXXXXXXXXXXXXXXXXXX-3'
3'-XXXXXXXXXXXXXXXXXXXXXXXXXXXXp-5'
``` wherein "X"=RNA, "p"=a phosphate group, and "X"=2'-O-methyl RNA. The top strand is the sense strand, and the bottom strand is the antisense strand. In a further related embodiment, the DsiRNA comprises:

```
5'-pXXXXXXXXXXXXXXXXXXXXXXXXXDD-3'
3'-XXXXXXXXXXXXXXXXXXXXXXXXXXXXp-5'
``` wherein "X"=RNA, "p"=a phosphate group, "X"=2'-O-methyl RNA, and "D"=DNA. The top strand is the sense strand, and the bottom strand is the antisense strand.

In further embodiments, the DsiRNA comprises:

```
5'-pXXXXXXXXXXXXXXXXXXXXXXXXX-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-pXXXXXXXXXXXXXXXXXXXXXXXXXDD-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-pXXXXXXXXXXXXXXXXXXXXXXXXX-3'
3'-XXXXXXXXXXXXXXXXXXXXXXXXXXXXp-5'
``` wherein "X"=RNA, "p"=a phosphate group, and "X"=2'-O-methyl RNA. The top strand is the sense strand, and the bottom strand is the antisense strand. In a further related embodiment, the DsiRNA comprises:

```
5'-pXXXXXXXXXXXXXXXXXXXXXXXXXDD-3'
3'-XXXXXXXXXXXXXXXXXXXXXXXXXXXXp-5'
``` wherein "X"=RNA, "p"=a phosphate group, "X"=2'-O-methyl RNA, and "D"=DNA. The top strand is the sense strand, and the bottom strand is the antisense strand.

In additional embodiments, the DsiRNA comprises:

```
5'-pXXXXXXXXXXXXXXXXXXXXXXXXX-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'430-methyl RNA monomers and underlined residues are 2'-O-methyl RNA monomers. The top strand is the sense strand, and the bottom strand is the antisense strand. In one related embodiment, the DsiRNA comprises:

```
5'-pXXXXXXXXXXXXXXXXXXXXXXXXXDD-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-pXXXXXXXXXXXXXXXXXXXXXXXXX-3'
3'-XXXXXXXXXXXXXXXXXXXXXXXXXXXXp-5'
``` wherein "X"=RNA, "p"=a phosphate group and "X"=2'-O-methyl RNA. The top strand is the sense strand, and the bottom strand is the antisense strand. In a further related embodiment, the DsiRNA comprises:

```
5'-pXXXXXXXXXXXXXXXXXXXXXXXXXDD-3'
3'-XXXXXXXXXXXXXXXXXXXXXXXXXXXXp-5'
``` wherein "X"=RNA, "p"=a phosphate group, "X"=2'-O-methyl RNA, and "D"=DNA. The top strand is the sense strand, and the bottom strand is the antisense strand.

In further embodiments, the DsiRNA comprises:

```
5'-pXXXXXXXXXXXXXXXXXXXXXXXXX-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-pXXXXXXXXXXXXXXXXXXXXXXXXXDD-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-pXXXXXXXXXXXXXXXXXXXXXXXXX-3'
3'-XXXXXXXXXXXXXXXXXXXXXXXXXXXp-5'
``` wherein "X"=RNA, "p"=a phosphate group and "X"=2'-O-methyl RNA. The top strand is the sense strand, and the bottom strand is the antisense strand. In a further related embodiment, the DsiRNA comprises:

```
5'-pXXXXXXXXXXXXXXXXXXXXXXXXXDD-3'
3'-XXXXXXXXXXXXXXXXXXXXXXXXXXXp-5'
``` wherein "X"=RNA, "p"=a phosphate group, "X"=2'-O-methyl RNA, and "D"=DNA. The top strand is the sense strand, and the bottom strand is the antisense strand.

In additional embodiments, the DsiRNA comprises:

```
5'-pXXXXXXXXXXXXXXXXXXXXXXXXX-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-pXXXXXXXXXXXXXXXXXXXXXXXXXDD-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-pXXXXXXXXXXXXXXXXXXXXXXXXX-3'
3'-XXXXXXXXXXXXXXXXXXXXXXXXXXXp-5'
``` wherein "X"=RNA, "p"=a phosphate group and "X"=2'-O-methyl RNA. The top strand is the sense strand, and the bottom strand is the antisense strand. In a further related embodiment, the DsiRNA comprises:

```
5'-pXXXXXXXXXXXXXXXXXXXXXXXXXDD-3'
3'-XXXXXXXXXXXXXXXXXXXXXXXXXXXp-5'
``` wherein "X"=RNA, "p"=a phosphate group, "X"=2'-O-methyl RNA, and "D"=DNA. The top strand is the sense strand, and the bottom strand is the antisense strand.

In additional embodiments, the DsiRNA comprises:

```
5'-pXXXXXXXXXXXXXXXXXXXXXXXXX-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-pXXXXXXXXXXXXXXXXXXXXXXXXXDD-3'
3'-YXXXXXXXXXXXXXXXXXXXXXXXXXXXp-5'
``` wherein "X"=RNA, "p"=a phosphate group, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

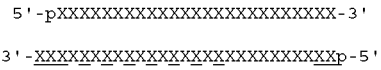

wherein "X"=RNA, "p"=a phosphate group and "X"=2'-O-methyl RNA. The top strand is the sense strand, and the bottom strand is the antisense strand. In a further related embodiment, the DsiRNA comprises:

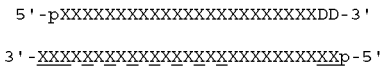

wherein "X"=RNA, "p"=a phosphate group, "X"=2'-O-methyl RNA, and "D"=DNA. The top strand is the sense strand, and the bottom strand is the antisense strand.

In further embodiments, the DsiRNA comprises:

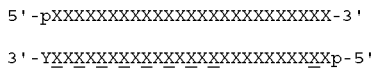

wherein "X"=RNA, "p"=a phosphate group, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

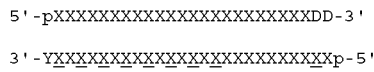

wherein "X"=RNA, "p"=a phosphate group, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

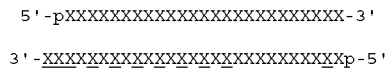

wherein "X"=RNA, "p"=a phosphate group and "X"=2'-O-methyl RNA. The top strand is the sense strand, and the bottom strand is the antisense strand. In a further related embodiment, the DsiRNA comprises:

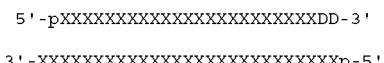

wherein "X"=RNA, "p"=a phosphate group, "X"=2'-O-methyl RNA, and "D"=DNA. The top strand is the sense strand, and the bottom strand is the antisense strand.

The above modification patterns can also be incorporated into, e.g., the extended DsiRNA structures and mismatch and/or frayed DsiRNA structures described below.

In another embodiment, the DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary 27mer DsiRNA agent with two terminal mismatched residues is shown:

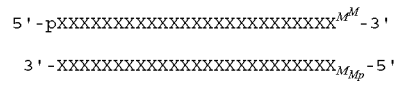

wherein "X"=RNA, "p"=a phosphate group, "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand is the sense strand, and the bottom strand is the antisense strand. Alternatively, the bottom strand is the sense strand and the top strand is the antisense strand.

In certain additional embodiments, the present invention provides compositions for RNA interference (RNAi) that possess one or more base paired deoxyribonucleotides within a region of a double stranded ribonucleic acid (dsRNA) that is positioned 3' of a projected sense strand Dicer cleavage site and correspondingly 5' of a projected antisense strand Dicer cleavage site. The compositions of the invention comprise a dsRNA which is a precursor molecule, i.e., the dsRNA of the present invention is processed in vivo to produce an active small interfering nucleic acid (siRNA). The dsRNA is processed by Dicer to an active siRNA which is incorporated into RISC.

In certain embodiments, the DsiRNA agents of the invention can have the following exemplary structures (noting that any of the following exemplary structures can be combined, e.g., with the bottom strand modification patterns of the above-described structures—in one specific example, the bottom strand modification pattern shown in any of the above structures is applied to the 27 most 3' residues of the bottom strand of any of the following structures; in another specific example, the bottom strand modification pattern shown in any of the above structures upon the 23 most 3' residues of the bottom strand is applied to the 23 most 3' residues of the bottom strand of any of the following structures):

In one such embodiment, the DsiRNA comprises the following (an exemplary "right-extended", "DNA extended" DsiRNA):

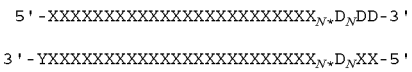

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

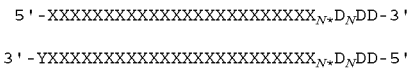

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

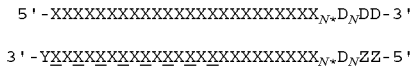

wherein "X"=RNA, "X"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

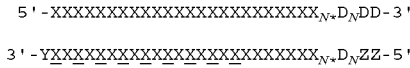

wherein "X"=RNA, "X"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

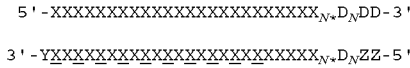

wherein "X"=RNA, "X"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

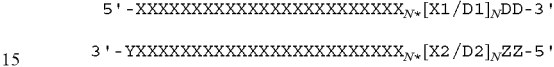

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In the structures depicted herein, the 5' end of either the sense strand or antisense strand can optionally comprise a phosphate group.

In another embodiment, the DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

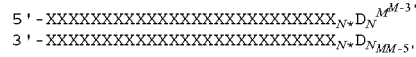

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-8 or 1-10. "N*"=0 to 15 or more, but is optionally 0, 1, 2, 3, 4, 5 or 6. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA:DNA extension patterns paralleling those shown above for asymmetric/overhang agents can also be incorporated into such "blunt/frayed" agents.

In one embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. An exemplary structure for such a molecule is shown:

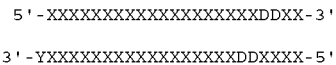

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the antisense strand. The above structure is modeled to force Dicer to cleave a minimum of a 21mer duplex as its primary post-processing form. In embodiments where the bottom strand of the above structure is the antisense strand, the positioning of two deoxyribonucleotide residues at the ultimate and penultimate residues of the 5' end of the antisense strand is likely to reduce off-target effects (as prior studies have shown a 2'-O-methyl modification of at least the penultimate position from the 5' terminus of the antisense strand to reduce off-target effects; see, e.g., US 2007/0223427).

In one embodiment, the DsiRNA comprises the following (an exemplary "left-extended", "DNA extended" DsiRNA):

5'-DNXXXXXXXXXXXXXXXXXXXXXXXXX$_{N*}$Y-3'

3'-DNXXXXXXXXXXXXXXXXXXXXXXXXX$_{N*}$-5' wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

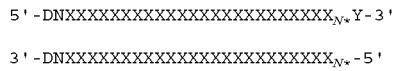

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

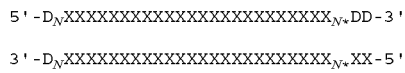

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

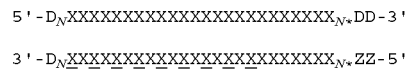

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

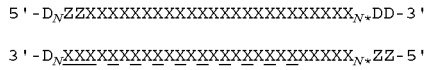

wherein "X"=RNA, "X"=2'-O-methyl RNA, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

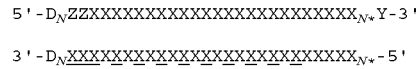

wherein "X"=RNA, "X"=2'-O-methyl RNA, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

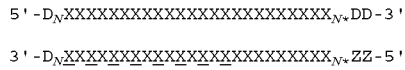

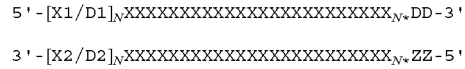

wherein "X"=RNA, "D"=DNA, "Z"=DNA or RNA, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In a related embodiment, the DsiRNA comprises:

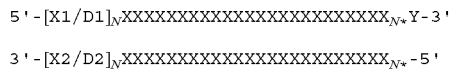

wherein "X"=RNA, "D"=DNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

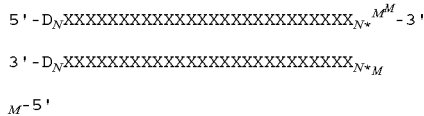

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-8 or 1-10. "N*"=0 to 15 or more, but is optionally 0, 1, 2, 3, 4, 5 or 6. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA:DNA extension patterns paralleling those shown above for asymmetric/overhang agents can also be incorporated into such "blunt/frayed" agents.

In another embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. An exemplary structure for such a molecule is shown:

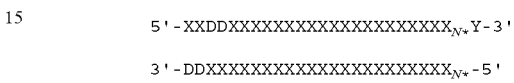

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand. The above structure is modeled to force Dicer to cleave a minimum of a 21mer duplex as its primary post-processing form. In embodiments where the bottom strand of the above structure is the antisense strand, the positioning of two deoxyribonucleotide residues at the ultimate and penultimate residues of the 5' end of the antisense strand is likely to reduce off-target effects (as prior studies have shown a 2'-O-methyl modification of at least the penultimate position from the 5' terminus of the antisense strand to reduce off-target effects; see, e.g., US 2007/0223427).

In certain embodiments, the "D" residues of the above structures include at least one PS-DNA or PS-RNA. Optionally, the "D" residues of the above structures include at least one modified nucleotide that inhibits Dicer cleavage.

While the above-described "DNA-extended" DsiRNA agents can be categorized as either "left extended" or "right extended", DsiRNA agents comprising both left- and right-extended DNA-containing sequences within a single agent (e.g., both flanks surrounding a core dsRNA structure are dsDNA extensions) can also be generated and used in similar manner to those described herein for "right-extended" and "left-extended" agents.

In some embodiments, the DsiRNA of the instant invention further comprises a linking moiety or domain that joins the sense and antisense strands of a DNA:DNA-extended DsiRNA agent. Optionally, such a linking moiety domain joins the 3' end of the sense strand and the 5' end of the antisense strand. The linking moiety may be a chemical (non-nucleotide) linker, such as an oligomethylenediol linker, oligoethylene glycol linker, or other art-recognized linker moiety. Alternatively, the linker can be a nucleotide linker, optionally including an extended loop and/or tetraloop.

In one embodiment, the DsiRNA agent has an asymmetric structure, with the sense strand having a 25-base pair length, and the antisense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxynucleotides at the 3' end of the sense strand.

In another embodiment, the DsiRNA agent has an asymmetric structure, with the antisense strand having a 25-base pair length, and the sense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxynucleotides at the 3' end of the antisense strand.

Exemplary KRAS targeting DsiRNA agents of the invention include the following: KRAS-355 Target Site

```
5'-CAGGUCAAGAGGAGUACAGUGCAau-3'       (SEQ ID NO: 5; DP1148P)
3'-UCGUCCAGUUCUCCUCAUGUCACGUUA-5'     (SEQ ID NO: 14; DP1151G)
5'-AGCAGGUCAAGAGGAGUACAGUGCAAU-3'     (SEQ ID NO: 6; DP1149P)
3'-UCGUCCAGUUCUCCUCAUGUCACGUUA-5'     (SEQ ID NO: 14; DP1151G)
5'-AGCAGGUCAAGAGGAGUACAGUGCA^{UA}-3'  (SEQ ID NO: 7; DP1150P)
3'-UCGUCCAGUUCUCCUCAUGUCACGU_{UA}-5'  (SEQ ID NO: 14; DP1151G)
```

KRAS-940 Target Site

```
5'-UUAGCAUUUGUUUUAGCAUUACCta-3'       (SEQ ID NO: 8; DP1136P)
3'-AUAAUCGUAAACAAAAUCGUAAUGGAU-5'     (SEQ ID NO: 43; DP1139G)
5'-UAUUAGCAUUUGUUUUAGCAUUACCUA-3'     (SEQ ID NO: 9; DP1137P)
3'-AUAAUCGUAAACAAAAUCGUAAUGGAU-5'     (SEQ ID NO: 43; DP1139G)
5'-UAUUAGCAUUUGUUUUAGCAUUACC^{CC}-3'  (SEQ ID NO: 10; DP1145P)
3'-AUAAUCGUAAACAAAAUCGUAAUGG_{AU}-5'  (SEQ ID NO: 43; DP1139G)
```

KRAS-355*Alternative (Polymorphic) Target Site

```
5'-CAGGUCAUGAGGAGUACAGUGCAau-3'       (SEQ ID NO: 132)
3'-UCGUCCAGUACUCCUCAUGUCACGUUA-5'     (SEQ ID NO: 138)
5'-AGCAGGUCAUGAGGAGUACAGUGCAAU-3'     (SEQ ID NO: 187)
3'-UCGUCCAGUACUCCUCAUGUCACGUUA-5'     (SEQ ID NO: 138)
5'-AGCAGGUCAUGAGGAGUACAGUGCA^{UA}-3'  (SEQ ID NO: 188)
3'-UCGUCCAGUACUCCUCAUGUCACGU_{UA}-5'  (SEQ ID NO: 138)
```

Other exemplary KRAS targeting DsiRNA agents of the invention include the following:

Lengthy table referenced here
US08372816-20130212-T00001
Please refer to the end of the specification for access instructions.

Lengthy table referenced here
US08372816-20130212-T00002
Please refer to the end of the specification for access instructions.

Lengthy table referenced here
US08372816-20130212-T00003
Please refer to the end of the specification for access instructions.

Lengthy table referenced here
US08372816-20130212-T00004
Please refer to the end of the specification for access instructions.

Lengthy table referenced here
US08372816-20130212-T00005
Please refer to the end of the specification for access instructions.

Projected 21mer target sequences for each DsiRNA are shown in Table 7.

TABLE 7

| DsiRNA Target Sequences (21 mers) | | | |
|---|---|---|---|
| KRAS-204 | Target: | 5'-TAGTTGGAGCTGGTGGCGTAG-3' | (SEQ ID NO: 6843) |
| KRAS-204* | Target: | 5'-TAGTTGGAGCTGTTGGCGTAG-3' | (SEQ ID NO: 6844) |
| KRAS-341 | Target: | 5'-GATATTCTCGACACAGCAGGT-3' | (SEQ ID NO: 6845) |
| KRAS-341* | Target: | 5'-GATATTCTCGACACAGCAGGT-3' | (SEQ ID NO: 6846) |
| KRAS-343 | Target: | 5'-TATTCTCGACACAGCAGGTCA-3' | (SEQ ID NO: 6847) |
| KRAS-343* | Target: | 5'-TATTCTCGACACAGCAGGTCA-3' | (SEQ ID NO: 6848) |
| KRAS-355 | Target: | 5'-AGCAGGTCAAGAGGAGTACAG-3' | (SEQ ID NO: 6849) |
| KRAS-355* | Target: | 5'-AGCAGGTCATGAGGAGTACAG-3' | (SEQ ID NO: 6850) |
| KRAS-361 | Target: | 5'-TCAAGAGGAGTACAGTGCAAT-3' | (SEQ ID NO: 6851) |
| KRAS-361* | Target: | 5'-TCATGAGGAGTACAGTGCAAT-3' | (SEQ ID NO: 6852) |
| KRAS-371 | Target: | 5'-TACAGTGCAATGAGGGACCAG-3' | (SEQ ID NO: 6853) |
| KRAS-401 | Target: | 5'-ACTGGGGAGGGCTTTCTTTGT-3' | (SEQ ID NO: 6854) |
| KRAS-404 | Target: | 5'-GGGGAGGGCTTTCTTTGTGTA-3' | (SEQ ID NO: 6855) |
| KRAS-406 | Target: | 5'-GGAGGGCTTTCTTTGTGTATT-3' | (SEQ ID NO: 6856) |
| KRAS-410 | Target: | 5'-GGCTTTCTTTGTGTATTTGCC-3' | (SEQ ID NO: 6857) |
| KRAS-415 | Target: | 5'-TCTTTGTGTATTTGCCATAAA-3' | (SEQ ID NO: 6858) |
| KRAS-416 | Target: | 5'-CTTTGTGTATTTGCCATAAAT-3' | (SEQ ID NO: 6859) |
| KRAS-417 | Target: | 5'-TTTGTGTATTTGCCATAAATA-3' | (SEQ ID NO: 6860) |
| KRAS-418 | Target: | 5'-TTGTGTATTTGCCATAAATAA-3' | (SEQ ID NO: 6861) |
| KRAS-419 | Target: | 5'-TGTGTATTTGCCATAAATAAT-3' | (SEQ ID NO: 6862) |
| KRAS-420 | Target: | 5'-GTGTATTTGCCATAAATAATA-3' | (SEQ ID NO: 6863) |
| KRAS-429 | Target: | 5'-CCATAAATAATACTAAATCAT-3' | (SEQ ID NO: 6864) |
| KRAS-434 | Target: | 5'-AATAATACTAAATCATTTGAA-3' | (SEQ ID NO: 6865) |
| KRAS-438 | Target: | 5'-ATACTAAATCATTTGAAGATA-3' | (SEQ ID NO: 6866) |
| KRAS-440 | Target: | 5'-ACTAAATCATTTGAAGATATT-3' | (SEQ ID NO: 6867) |
| KRAS-445 | Target: | 5'-ATCATTTGAAGATATTCACCA-3' | (SEQ ID NO: 6868) |
| KRAS-450 | Target: | 5'-TTGAAGATATTCACCATTATA-3' | (SEQ ID NO: 6869) |
| KRAS-452 | Target: | 5'-GAAGATATTCACCATTATAGA-3' | (SEQ ID NO: 6870) |
| KRAS-508 | Target: | 5'-ACCTATGGTCCTAGTAGGAAA-3' | (SEQ ID NO: 6871) |
| KRAS-534 | Target: | 5'-GTGATTTGCCTTCTAGAACAG-3' | (SEQ ID NO: 6872) |
| KRAS-760 | Target: | 5'-TTGATGATGCCTTCTATACAT-3' | (SEQ ID NO: 6873) |
| KRAS-776 | Target: | 5'-TACATTAGTTCGAGAAATTCG-3' | (SEQ ID NO: 6874) |
| KRAS-786 | Target: | 5'-CGAGAAATTCGAAAACATAAA-3' | (SEQ ID NO: 6875) |
| KRAS-795 | Target: | 5'-CGAAAACATAAAGAAAAGATG-3' | (SEQ ID NO: 6876) |
| KRAS-800 | Target: | 5'-ACATAAAGAAAAGATGAGCAA-3' | (SEQ ID NO: 6877) |
| KRAS-800* | Target: | 5'-ACATAAAGAAAAGATGAGCAA-3' | (SEQ ID NO: 6878) |
| KRAS-920 | Target: | 5'-TTTTGTACATTACACTAAATT-3' | (SEQ ID NO: 6879) |
| KRAS-935 | Target: | 5'-TAAATTATTAGCATTTGTTTT-3' | (SEQ ID NO: 6880) |
| KRAS-940 | Target: | 5'-TATTAGCATTTGTTTTAGCAT-3' | (SEQ ID NO: 6881) |

TABLE 7 -continued

| DsiRNA Target Sequences (21 mers) | | |
|---|---|---|
| KRAS-1032 Target: 5'-GAAGTTTTTTTTCCTCTAAG-3' | (SEQ ID NO: 6882) |
| KRAS-1048 Target: 5'-CTAAGTGCCAGTATTCCCAGA3' | (SEQ ID NO: 6883) |
| KRAS-1188 Target: 5'-TTGGTGTGAAACAAATTAATG-3' | (SEQ ID NO: 6884) |
| KRAS-1256 Target: 5'-GGATTAATTACTAATTTCAGT-3' | (SEQ ID NO: 6885) |
| KRAS-1634 Target: 5'-GCTATATTTACATGCTACTAA-3' | (SEQ ID NO: 6886) |
| KRAS-5134 Target: 5'-ATTTTAACTATTTTTGTATAG-3' | (SEQ ID NO: 6887) |
| KRAS-5208 Target: 5'-TGCAGTGTGATCCAGTTGTTT-3' | (SEQ ID NO: 6888) |
| KRAS-174 Target: 5'-TGCTGAAAATGACTGAATATA-3' | (SEQ ID NO: 6889) |
| KRAS-180 Target: 5'-AAATGACTGAATATAAACTTG-3' | (SEQ ID NO: 6890) |
| KRAS-184 Target: 5'-GACTGAATATAAACTTGTGGT-3' | (SEQ ID NO: 6891) |
| KRAS-246 Target: 5'-AGCTAATTCAGAATCATTTTG-3' | (SEQ ID NO: 6892) |
| KRAS-270 Target: 5'-ACGAATATGATCCAACAATAG-3' | (SEQ ID NO: 6893) |
| KRAS-306 Target: 5'-AGCAAGTAGTAATTGATGGAG-3' | (SEQ ID NO: 6894) |
| KRAS-406 Target: 5'-GGAGGGCTTTCTTTGTGTATT-3' | (SEQ ID NO: 6895) |
| KRAS-415 Target: 5'-TCTTTGTGTATTTGCCATAAA-3' | (SEQ ID NO: 6896) |
| KRAS-416 Target: 5'-CTTTGTGTATTTGCCATAAAT-3' | (SEQ ID NO: 6897) |
| KRAS-417 Target: 5'-TTTGTGTATTTGCCATAAATA-3' | (SEQ ID NO: 6898) |
| KRAS-418 Target: 5'-TTGTGTATTTGCCATAAATAA-3' | (SEQ ID NO: 6899) |
| KRAS-422 Target: 5'-GTATTTGCCATAAATAATACT-3' | (SEQ ID NO: 6900) |
| KRAS-423 Target: 5'-TATTTGCCATAAATAATACTA73' | (SEQ ID NO: 6901) |
| KRAS-429 Target: 5'-CCATAAATAATACTAAATCAT-3' | (SEQ ID NO: 6902) |
| KRAS-430 Target: 5'-CATAAATAATACTAAATCATT-3' | (SEQ ID NO: 6903) |
| KRAS-432 Target: 5'-TAAATAATACTAAATCATTTG-3' | (SEQ ID NO: 6904) |
| KRAS-433 Target: 5'-AAATAATACTAAATCATTTGA-3' | (SEQ ID NO: 6905) |
| KRAS-434 Target: 5'-AATAATACTAAATCATTTGAA-3' | (SEQ ID NO: 6906) |
| KRAS-435 Target: 5'-ATAATACTAAATCATTTGAAG-3' | (SEQ ID NO: 6907) |
| KRAS-448 Target: 5'-ATTTGAAGATATTCACCATTA-3' | (SEQ ID NO: 6908) |
| KRAS-450 Target: 5'-TTGAAGATATTCACCATTATA-3' | (SEQ ID NO: 6909) |
| KRAS-451 Target: 5'-TGAAGATATTCACCATTATAG-3' | (SEQ ID NO: 6910) |
| KRAS-452 Target: 5'-GAAGATATTCACCATTATAGA-3' | (SEQ ID NO: 6911) |
| KRAS-453 Target: 5'-AAGATATTCACCATTATAGAG-3' | (SEQ ID NO: 6912) |
| KRAS-463 Target: 5'-CCATTATAGAGAACAAATTAA-3' | (SEQ ID NO: 6913) |
| KRAS-465 Target: 5'-ATTATAGAGAACAAATTAAAA-3' | (SEQ ID NO: 6914) |
| KRAS-466 Target: 5'-TTATAGAGAACAAATTAAAAG-3' | (SEQ ID NO: 6915) |
| KRAS-467 Target: 5'-TATAGAGAACAAATTAAAAGA-3' | (SEQ ID NO: 6916) |
| KRAS-468 Target: 5'-ATAGAGAACAAATTAAAAGAG-3' | (SEQ ID NO: 6917) |
| KRAS-518 Target: 5'-CTAGTAGGAAATAAATGTGAT-3' | (SEQ ID NO: 6918) |
| KRAS-519 Target: 5'-TAGTAGGAAATAAATGTGATT-3' | (SEQ ID NO: 6919) |
| KRAS-583 Target: 5'-AAGAAGTTATGGAATTCCTTT-3' | (SEQ ID NO: 6920) |

TABLE 7 -continued

| DsiRNA Target Sequences (21 mers) | | |
|---|---|---|
| KRAS-586 | Target: 5'-AAGTTATGGAATTCCTTTTAT-3' | (SEQ ID NO: 6921) |
| KRAS-587 | Target: 5'-AGTTATGGAATTCCTTTTATT-3' | (SEQ ID NO: 6922) |
| KRAS-588 | Target: 5'-GTTATGGAATTCCTTTTATTG-3' | (SEQ ID NO: 6923) |
| KRAS-589 | Target: 5'-TTATGGAATTCCTTTTATTGA-3' | (SEQ ID NO: 6924) |
| KRAS-636 | Target: 5'-TGGAGGATGCTTTTTATACAT-3' | (SEQ ID NO: 6925) |
| KRAS-638 | Target: 5'-GAGGATGCTTTTTATACATTG-3' | (SEQ ID NO: 6926) |
| KRAS-678 | Target: 5'-ACAGATTGAAAAAAATCAGCA-3' | (SEQ ID NO: 6927) |
| KRAS-679 | Target: 5'-CAGATTGAAAAAAATCAGCAA-3' | (SEQ ID NO: 6928) |
| KRAS-681 | Target: 5'-GATTGAAAAAAATCAGCAAAG-3' | (SEQ ID NO: 6929) |
| KRAS-682 | Target: 5'-ATTGAAAAAAATCAGCAAAGA-3' | (SEQ ID NO: 6930) |
| KRAS-683 | Target: 5'-TTGAAAAAAATCAGCAAAGAA-3' | (SEQ ID NO: 6931) |
| KRAS-684 | Target: 5'-TGAAAAAAATCAGCAAAGAAG-3' | (SEQ ID NO: 6932) |
| KRAS-712 | Target: 5'-TCCTGGCTGTGTGAAAATTAA-3' | (SEQ ID NO: 6933) |
| KRAS-716 | Target: 5'-GGCTGTGTGAAAATTAAAAAA-3' | (SEQ ID NO: 6934) |
| KRAS-720 | Target: 5'-GTGTGAAAATTAAAAAATGCA-3' | (SEQ ID NO: 6935) |
| KRAS-721 | Target: 5'-TGTGAAAATTAAAAAATGCAT-3' | (SEQ ID NO: 6936) |
| KRAS-722 | Target: 5'-GTGAAAATTAAAAAATGCATT-3' | (SEQ ID NO: 6937) |
| KRAS-723 | Target: 5'-TGAAAATTAAAAAATGCATTA-3' | (SEQ ID NO: 6938) |
| KRAS-725 | Target: 5'-AAAATTAAAAAATGCATTATA-3' | (SEQ ID NO: 6939) |
| KRAS-726 | Target: 5'-AAATTAAAAAATGCATTATAA-3' | (SEQ ID NO: 6940) |
| KRAS-727 | Target: 5'-AATTAAAAAATGCATTATAAT-3' | (SEQ ID NO: 6941) |
| KRAS-728 | Target: 5'-ATTAAAAAATGCATTATAATG-3' | (SEQ ID NO: 6942) |
| KRAS-730 | Target: 5'-TAAAAAATGCATTATAATGTA-3' | (SEQ ID NO: 6943) |
| KRAS-737 | Target: 5'-TGCATTATAATGTAATCTGGG-3' | (SEQ ID NO: 6944) |
| KRAS-784 | Target: 5'-TTCGAGAAATTCGAAAACATA-3' | (SEQ ID NO: 6945) |
| KRAS-785 | Target: 5'-TCGAGAAATTCGAAAACATAA-3' | (SEQ ID NO: 6946) |
| KRAS-786 | Target: 5'-CGAGAAATTCGAAAACATAAA-3' | (SEQ ID NO: 6947) |
| KRAS-789 | Target: 5'-GAAATTCGAAAACATAAAGAA-3' | (SEQ ID NO: 6948) |
| KRAS-794 | Target: 5'-TCGAAAACATAAAGAAAAGAT-3' | (SEQ ID NO: 6949) |
| KRAS-795 | Target: 5'-CGAAAACATAAAGAAAAGATG-3' | (SEQ ID NO: 6950) |
| KRAS-819 | Target: 5'-AAAGATGGTAAAAAGAAGAAA-3' | (SEQ ID NO: 6951) |
| KRAS-820 | Target: 5'-AAGATGGTAAAAAGAAGAAAA-3' | (SEQ ID NO: 6952) |
| KRAS-822 | Target: 5'-GATGGTAAAAAGAAGAAAAAG-3' | (SEQ ID NO: 6953) |
| KRAS-823 | Target: 5'-ATGGTAAAAAGAAGAAAAAGA-3' | (SEQ ID NO: 6954) |
| KRAS-828 | Target: 5'-AAAAAGAAGAAAAAGAAGTCA-3' | (SEQ ID NO: 6955) |
| KRAS-829 | Target: 5'-AAAAGAAGAAAAAGAAGTCAA-3' | (SEQ ID NO: 6956) |
| KRAS-830 | Target: 5'-AAAGAAGAAAAAGAAGTCAAA-3' | (SEQ ID NO: 6957) |
| KRAS-846 | Target: 5'-TCAAAGACAAAGTGTGTAATT-3' | (SEQ ID NO: 6958) |
| KRAS-847 | Target: 5'-CAAAGACAAAGTGTGTAATTA-3' | (SEQ ID NO: 6959) |

TABLE 7 -continued

DsiRNA Target Sequences (21 mers)

| | | | |
|---|---|---|---|
| KRAS-851 | Target: | 5'-GACAAAGTGTGTAATTATGTA-3' | (SEQ ID NO: 6960) |
| KRAS-853 | Target: | 5'-CAAAGTGTGTAATTATGTAAA-3' | (SEQ ID NO: 6961) |
| KRAS-857 | Target: | 5'-GTGTGTAATTATGTAAATACA-3' | (SEQ ID NO: 6962) |
| KRAS-859 | Target: | 5'-GTGTAATTATGTAAATACAAT-3' | (SEQ ID NO: 6963) |
| KRAS-861 | Target: | 5'-GTAATTATGTAAATACAATTT-3' | (SEQ ID NO: 6964) |
| KRAS-862 | Target: | 5'-TAATTATGTAAATACAATTTG-3' | (SEQ ID NO: 6965) |
| KRAS-866 | Target: | 5'-TATGTAAATACAATTTGTACT-3' | (SEQ ID NO: 6966) |
| KRAS-867 | Target: | 5'-ATGTAAATACAATTTGTACTT-3' | (SEQ ID NO: 6967) |
| KRAS-868 | Target: | 5'-TGTAAATACAATTTGTACTTT-3' | (SEQ ID NO: 6968) |
| KRAS-869 | Target: | 5'-GTAAATACAATTTGTACTTTT-3' | (SEQ ID NO: 6969) |
| KRAS-875 | Target: | 5'-ACAATTTGTACTTTTTCTTA-3' | (SEQ ID NO: 6970) |
| KRAS-876 | Target: | 5'-CAATTTGTACTTTTTCTTAA-3' | (SEQ ID NO: 6971) |
| KRAS-901 | Target: | 5'-TACTAGTACAAGTGGTAATTT-3' | (SEQ ID NO: 6972) |
| KRAS-902 | Target: | 5'-ACTAGTACAAGTGGTAATTTT-3' | (SEQ ID NO: 6973) |
| KRAS-908 | Target: | 5'-ACAAGTGGTAATTTTGTACA-3' | (SEQ ID NO: 6974) |
| KRAS-909 | Target: | 5'-CAAGTGGTAATTTTGTACAT-3' | (SEQ ID NO: 6975) |
| KRAS-916 | Target: | 5'-TAATTTTGTACATTACACTA-3' | (SEQ ID NO: 6976) |
| KRAS-917 | Target: | 5'-AATTTTGTACATTACACTAA-3' | (SEQ ID NO: 6977) |
| KRAS-918 | Target: | 5'-ATTTTGTACATTACACTAAA-3' | (SEQ ID NO: 6978) |
| KRAS-919 | Target: | 5'-TTTTTGTACATTACACTAAAT-3' | (SEQ ID NO: 6979) |
| KRAS-920 | Target: | 5'-TTTTGTACATTACACTAAATT-3' | (SEQ ID NO: 6980) |
| KRAS-932 | Target: | 5'-CACTAAATTATTAGCATTTGT-3' | (SEQ ID NO: 6981) |
| KRAS-934 | Target: | 5'-CTAAATTATTAGCATTTGTTT-3' | (SEQ ID NO: 6982) |
| KRAS-935 | Target: | 5'-TAAATTATTAGCATTTGTTTT-3' | (SEQ ID NO: 6983) |
| KRAS-940 | Target: | 5'-TATTAGCATTTGTTTTAGCAT-3' | (SEQ ID NO: 6984) |
| KRAS-946 | Target: | 5'-CATTTGTTTTAGCATTACCTA-3' | (SEQ ID NO: 6985) |
| KRAS-947 | Target: | 5'-ATTTGTTTTAGCATTACCTAA-3' | (SEQ ID NO: 6986) |
| KRAS-949 | Target: | 5'-TTGTTTTAGCATTACCTAATT-3' | (SEQ ID NO: 6987) |
| KRAS-950 | Target: | 5'-TGTTTTAGCATTACCTAATTT-3' | (SEQ ID NO: 6988) |
| KRAS-951 | Target: | 5'-GTTTTAGCATTACCTAATTTT-3' | (SEQ ID NO: 6989) |
| KRAS-952 | Target: | 5'-TTTTAGCATTACCTAATTTTT-3' | (SEQ ID NO: 6990) |
| KRAS-988 | Target: | 5'-GACTGTTAGCTTTTACCTTAA-3' | (SEQ ID NO: 6991) |
| KRAS-989 | Target: | 5'-ACTGTTAGCTTTTACCTTAAA-3' | (SEQ ID NO: 6992) |
| KRAS-995 | Target: | 5'-AGCTTTTACCTTAAATGCTTA-3' | (SEQ ID NO: 6993) |
| KRAS-996 | Target: | 5'-GCTTTTACCTTAAATGCTTAT-3' | (SEQ ID NO: 6994) |
| KRAS-997 | Target: | 5'-CTTTTACCTTAAATGCTTATT-3' | (SEQ ID NO: 6995) |
| KRAS-1003 | Target: | 5'-CCTTAAATGCTTATTTTAAAA-3' | (SEQ ID NO: 6996) |
| KRAS-1004 | Target: | 5'-CTTAAATGCTTATTTTAAAAT-3' | (SEQ ID NO: 6997) |
| KRAS-1010 | Target: | 5'-TGCTTATTTTAAAATGACAGT-3' | (SEQ ID NO: 6998) |

TABLE 7 -continued

| DsiRNA Target Sequences (21 mers) | | |
|---|---|---|
| KRAS-1012 Target: | 5'-CTTATTTTAAAATGACAGTGG-3' | (SEQ ID NO: 6999) |
| KRAS-1029 Target: | 5'-GTGGAAGTTTTTTTTCCTCT-3' | (SEQ ID NO: 7000) |
| KRAS-1031 Target: | 5'-GGAAGTTTTTTTTCCTCTAA-3' | (SEQ ID NO: 7001) |
| KRAS-1032 Target: | 5'-GAAGTTTTTTTTCCTCTAAG-3' | (SEQ ID NO: 7002) |
| KRAS-1070 Target: | 5'-TTTTGGTTTTTGAACTAGCAA-3' | (SEQ ID NO: 7003) |
| KRAS-1092 Target: | 5'-GCCTGTGAAAAGAAACTGAA-3' | (SEQ ID NO: 7004) |
| KRAS-1099 Target: | 5'-AAAAGAAACTGAATACCTAA-3' | (SEQ ID NO: 7005) |
| KRAS-1100 Target: | 5'-AAAGAAACTGAATACCTAAG-3' | (SEQ ID NO: 7006) |
| KRAS-1106 Target: | 5'-AACTGAATACCTAAGATTTCT-3' | (SEQ ID NO: 7007) |
| KRAS-1147 Target: | 5'-TGCAGTTGATTACTTCTTATT-3' | (SEQ ID NO: 7008) |
| KRAS-1148 Target: | 5'-GCAGTTGATTACTTCTTATTT-3' | (SEQ ID NO: 7009) |
| KRAS-1152 Target: | 5'-TTGATTACTTCTTATTTTCT-3' | (SEQ ID NO: 7010) |
| KRAS-1160 Target: | 5'-TTCTTATTTTCTTACCAATT-3' | (SEQ ID NO: 7011) |
| KRAS-1161 Target: | 5'-TCTTATTTTCTTACCAATTG-3' | (SEQ ID NO: 7012) |
| KRAS-1162 Target: | 5'-CTTATTTTCTTACCAATTGT-3' | (SEQ ID NO: 7013) |
| KRAS-1185 Target: | 5'-ATGTTGGTGTGAAACAAATTA-3' | (SEQ ID NO: 7014) |
| KRAS-1188 Target: | 5'-TTGGTGTGAAACAAATTAATG-3' | (SEQ ID NO: 7015) |
| KRAS-1189 Target: | 5'-TGGTGTGAAACAAATTAATGA-3' | (SEQ ID NO: 7016) |
| KRAS-1197 Target: | 5'-AACAAATTAATGAAGCTTTTG-3' | (SEQ ID NO: 7017) |
| KRAS-1198 Target: | 5'-ACAAATTAATGAAGCTTTTGA-3' | (SEQ ID NO: 7018) |
| KRAS-1230 Target: | 5'-TCTGTGTTTTATCTAGTCACA-3' | (SEQ ID NO: 7019) |
| KRAS-1231 Target: | 5'-CTGTGTTTTATCTAGTCACAT-3' | (SEQ ID NO: 7020) |
| KRAS-1234 Target: | 5'-TGTTTTATCTAGTCACATAAA-3' | (SEQ ID NO: 7021) |
| KRAS-1235 Target: | 5'-GTTTTATCTAGTCACATAAAT-3' | (SEQ ID NO: 7022) |
| KRAS-1240 Target: | 5'-ATCTAGTCACATAAATGGATT-3' | (SEQ ID NO: 7023) |
| KRAS-1241 Target: | 5'-TCTAGTCACATAAATGGATTA-3' | (SEQ ID NO: 7024) |
| KRAS-1249 Target: | 5'-CATAAATGGATTAATTACTAA-3' | (SEQ ID NO: 7025) |
| KRAS-1250 Target: | 5'-ATAAATGGATTAATTACTAAT-3' | (SEQ ID NO: 7026) |
| KRAS-1255 Target: | 5'-TGGATTAATTACTAATTTCAG-3' | (SEQ ID NO: 7027) |
| KRAS-1257 Target: | 5'-GATTAATTACTAATTTCAGTT-3' | (SEQ ID NO: 7028) |
| KRAS-1258 Target: | 5'-ATTAATTACTAATTTCAGTTG-3' | (SEQ ID NO: 7029) |
| KRAS-1259 Target: | 5'-TTAATTACTAATTTCAGTTGA-3' | (SEQ ID NO: 7030) |
| KRAS-1287 Target: | 5'-TAATTGGTTTTTACTGAAACA-3' | (SEQ ID NO: 7031) |
| KRAS-1291 Target: | 5'-TGGTTTTTACTGAAACATTGA-3' | (SEQ ID NO: 7032) |
| KRAS-1292 Target: | 5'-GGTTTTTACTGAAACATTGAG-3' | (SEQ ID NO: 7033) |
| KRAS-1307 Target: | 5'-ATTGAGGGAACACAAATTTAT-3' | (SEQ ID NO: 7034) |
| KRAS-1308 Target: | 5'-TTGAGGGAACACAAATTTATG-3' | (SEQ ID NO: 7035) |
| KRAS-1381 Target: | 5'-TGATGAATGTAAAGTTACACT-3' | (SEQ ID NO: 7036) |
| KRAS-1382 Target: | 5'-GATGAATGTAAAGTTACACTG-3' | (SEQ ID NO: 7037) |

TABLE 7 -continued

| DsiRNA Target Sequences (21 mers) | | |
|---|---|---|
| KRAS-1454 Target: | 5'-CCAAAATATTATATTTTTCT-3' | (SEQ ID NO: 7038) |
| KRAS-1455 Target: | 5'-CAAAATATTATATTTTTCTA-3' | (SEQ ID NO: 7039) |
| KRAS-1456 Target: | 5'-AAAAtATTATATTTTTCTAT-3' | (SEQ ID NO: 7040) |
| KRAS-1457 Target: | 5'-AAATATTATATTTTTCTATA-3' | (SEQ ID NO: 7041) |
| KRAS-1459 Target: | 5'-ATATTATATTTTTCTATAAA-3' | (SEQ ID NO: 7042) |
| KRAS-1460 Target: | 5'-TATTATATTTTTCTATAAAA-3' | (SEQ ID NO: 7043) |
| KRAS-1461 Target: | 5'-ATTATATTTTTCTATAAAAA-3' | (SEQ ID NO: 7044) |
| KRAS-1462 Target: | 5'-TTATATTTTTCTATAAAAAG-3' | (SEQ ID NO: 7045) |
| KRAS-1463 Target: | 5'-TATATTTTTCTATAAAAAGA-3' | (SEQ ID NO: 7046) |
| KRAS-1464 Target: | 5'-ATATTTTTCTATAAAAAGAA-3' | (SEQ ID NO: 7047) |
| KRAS-1465 Target: | 5'-TATTTTTCTATAAAAAGAAA-3' | (SEQ ID NO: 7048) |
| KRAS-1466 Target: | 5'-ATTTTTCTATAAAAAGAAAA-3' | (SEQ ID NO: 7049) |
| KRAS-1471 Target: | 5'-TTCTATAAAAAGAAAAAATG-3' | (SEQ ID NO: 7050) |
| KRAS-1472 Target: | 5'-TCTATAAAAAGAAAAAATGG-3' | (SEQ ID NO: 7051) |
| KRAS-1474 Target: | 5'-TATAAAAAGAAAAAATGGAA-3' | (SEQ ID NO: 7052) |
| KRAS-1475 Target: | 5'-ATAAAAAGAAAAAATGGAAA-3' | (SEQ ID NO: 7053) |
| KRAS-1476 Target: | 5'-TAAAAAGAAAAAATGGAAAA-3' | (SEQ ID NO: 7054) |
| KRAS-1477 Target: | 5'-AAAAAGAAAAAATGGAAAAA-3' | (SEQ ID NO: 7055) |
| KRAS-1478 Target: | 5'-AAAAGAAAAAATGGAAAAAA-3' | (SEQ ID NO: 7056) |
| KRAS-1479 Target: | 5'-AAAGAAAAAATGGAAAAAAT-3' | (SEQ ID NO: 7057) |
| KRAS-1480 Target: | 5'-AAGAAAAAATGGAAAAAAT-3' | (SEQ ID NO: 7058) |
| KRAS-1484 Target: | 5'-AAAAAATGGAAAAAATTACA-3' | (SEQ ID NO: 7059) |
| KRAS-1485 Target: | 5'-AAAAATGGAAAAAATTACAA-3' | (SEQ ID NO: 7060) |
| KRAS-1490 Target: | 5'-TGGAAAAAAATTACAAGGCAA-3' | (SEQ ID NO: 7061) |
| KRAS-1491 Target: | 5'-GGAAAAAATTACAAGGCAAT-3' | (SEQ ID NO: 7062) |
| KRAS-1492 Target: | 5'-GAAAAAATTACAAGGCAATG-3' | (SEQ ID NO: 7063) |
| KRAS-1527 Target: | 5'-GCCATTTCCTTTTCACATTAG-3' | (SEQ ID NO: 7064) |
| KRAS-1533 Target: | 5'-TCCTTTTCACATTAGATAAAT-3' | (SEQ ID NO: 7065) |
| KRAS-1540 Target: | 5'-CACATTAGATAAATTACTATA-3' | (SEQ ID NO: 7066) |
| KRAS-1541 Target: | 5'-ACATTAGATAAATTACTATAA-3' | (SEQ ID NO: 7067) |
| KRAS-1542 Target: | 5'-CATTAGATAAATTACTATAAA-3' | (SEQ ID NO: 7068) |
| KRAS-1597 Target: | 5'-AGTATGAAATGGGGATTATTA-3' | (SEQ ID NO: 7069) |
| KRAS-1606 Target: | 5'-TGGGGATTATTATAGCAACCA-3' | (SEQ ID NO: 7070) |
| KRAS-1633 Target: | 5'-GGCTATATTTACATGCTACTA-3' | (SEQ ID NO: 7071) |
| KRAS-1634 Target: | 5'-GCTATATTTACATGCTACTAA-3' | (SEQ ID NO: 7072) |
| KRAS-1635 Target: | 5'-CTATATTTACATGCTACTAAA-3' | (SEQ ID NO: 7073) |
| KRAS-1636 Target: | 5'-TATATTTACATGCTACTAAAT-3' | (SEQ ID NO: 7074) |
| KRAS-1637 Target: | 5'-ATATTTACATGCTACTAAATT-3' | (SEQ ID NO: 7075) |
| KRAS-1642 Target: | 5'-TACATGCTACTAAATTTTTAT-3' | (SEQ ID NO: 7076) |

TABLE 7 -continued

| DsiRNA Target Sequences (21 mers) | | |
|---|---|---|
| KRAS-1649 Target: 5'-TACTAAATTTTATAATAATT-3' | (SEQ ID NO: 7077) | |
| KRAS-1650 Target: 5'-ACTAAATTTTATAATAATTG-3' | (SEQ ID NO: 7078) | |
| KRAS-1652 Target: 5'-TAAATTTTATAATAATTGAA-3' | (SEQ ID NO: 7079) | |
| KRAS-1653 Target: 5'-AAATTTTATAATAATTGAAA-3' | (SEQ ID NO: 7080) | |
| KRAS-1654 Target: 5'-AATTTTATAATAATTGAAAA-3' | (SEQ ID NO: 7081) | |
| KRAS-1655 Target: 5'-ATTTTATAATAATTGAAAAG-3' | (SEQ ID NO: 7082) | |
| KRAS-1656 Target: 5'-TTTTTATAATAATTGAAAAGA-3' | (SEQ ID NO: 7083) | |
| KRAS-1657 Target: 5'-TTTTATAATAATTGAAAAGAT-3' | (SEQ ID NO: 7084) | |
| KRAS-1658 Target: 5'-TTTATAATAATTGAAAAGATT-3' | (SEQ ID NO: 7085) | |
| KRAS-1659 Target: 5'-TTATAATAATTGAAAAGATTT-3' | (SEQ ID NO: 7086) | |
| KRAS-1660 Target: 5'-TATAATAATTGAAAAGATTTT-3' | (SEQ ID NO: 7087) | |
| KRAS-1664 Target: 5'-ATAATTGAAAAGATTTTAACA-3' | (SEQ ID NO: 7088) | |
| KRAS-1665 Target: 5'-TAATTGAAAAGATTTTAACAA-3' | (SEQ ID NO: 7089) | |
| KRAS-1667 Target: 5'-ATTGAAAAGATTTTAACAAGT-3' | (SEQ ID NO: 7090) | |
| KRAS-1668 Target: 5'-TTGAAAAGATTTTAACAAGTA-3' | (SEQ ID NO: 7091) | |
| KRAS-1669 Target: 5'-TGAAAAGATTTTAACAAGTAT-3' | (SEQ ID NO: 7092) | |
| KRAS-1670 Target: 5'-GAAAAGATTTTAACAAGTATA-3' | (SEQ ID NO: 7093) | |
| KRAS-1671 Target: 5'-AAAAGATTTTAACAAGTATAA-3' | (SEQ ID NO: 7094) | |
| KRAS-1672 Target: 5'-AAAGATTTTAACAAGTATAAA-3' | (SEQ ID NO: 7095) | |
| KRAS-1673 Target: 5'-AAGATTTTAACAAGTATAAAA-3' | (SEQ ID NO: 7096) | |
| KRAS-1674 Target: 5'-AGATTTTAACAAGTATAAAAA-3' | (SEQ ID NO: 7097) | |
| KRAS-1675 Target: 5'-GATTTTAACAAGTATAAAAAA-3' | (SEQ ID NO: 7098) | |
| KRAS-1682 Target: 5'-ACAAGTATAAAAAATTCTCAT-3' | (SEQ ID NO: 7099) | |
| KRAS-1683 Target: 5'-CAAGTATAAAAAATTCTCATA-3' | (SEQ ID NO: 7100) | |
| KRAS-1684 Target: 5'-AAGTATAAAAAATTCTCATAG-3' | (SEQ ID NO: 7101) | |
| KRAS-1685 Target: 5'-AGTATAAAAAATTCTCATAGG-3' | (SEQ ID NO: 7102) | |
| KRAS-1686 Target: 5'-GTATAAAAAATTCTCATAGGA-3' | (SEQ ID NO: 7103) | |
| KRAS-1687 Target: 5'-TATAAAAAATTCTCATAGGAA-3' | (SEQ ID NO: 7104) | |
| KRAS-1688 Target: 5'-ATAAAAAATTCTCATAGGAAT-3' | (SEQ ID NO: 7105) | |
| KRAS-1689 Target: 5'-TAAAAAATTCTCATAGGAATT-3' | (SEQ ID NO: 7106) | |
| KRAS-1691 Target: 5'-AAAAATTCTCATAGGAATTAA-3' | (SEQ ID NO: 7107) | |
| KRAS-1692 Target: 5'-AAAATTCTCATAGGAATTAAA-3' | (SEQ ID NO: 7108) | |
| KRAS-1736 Target: 5'-CTCTTTCATAGTATAACTTTA-3' | (SEQ ID NO: 7109) | |
| KRAS-1741 Target: 5'-TCATAGTATAACTTTAAATCT-3' | (SEQ ID NO: 7110) | |
| KRAS-1742 Target: 5'-CATAGTATAACTTTAAATCTT-3' | (SEQ ID NO: 7111) | |
| KRAS-1753 Target: 5'-TTTAAATCTTTTCTTCAACTT-3' | (SEQ ID NO: 7112) | |
| KRAS-1754 Target: 5'-TTAAATCTTTTCTTCAACTTG-3' | (SEQ ID NO: 7113) | |
| KRAS-1769 Target: 5'-AACTTGAGTCTTTGAAGATAG-3' | (SEQ ID NO: 7114) | |
| KRAS-1771 Target: 5'-CTTGAGTCTTTGAAGATAGTT-3' | (SEQ ID NO: 7115) | |

TABLE 7 -continued

| DsiRNA Target Sequences (21 mers) | | |
|---|---|---|
| KRAS-1772 Target: | 5'-TTGAGTCTTTGAAGATAGTTT-3' | (SEQ ID NO: 7116) |
| KRAS-1783 Target: | 5'-AAGATAGTTTTAATTCTGCTT-3' | (SEQ ID NO: 7117) |
| KRAS-1784 Target: | 5'-AGATAGTTTTAATTCTGCTTG-3' | (SEQ ID NO: 7118) |
| KRAS-1785 Target: | 5'-GATAGTTTTAATTCTGCTTGT-3' | (SEQ ID NO: 7119) |
| KRAS-1799 Target: | 5'-TGCTTGTGACATTAAAAGATT-3' | (SEQ ID NO: 7120) |
| KRAS-2047 Target: | 5'-AGCATTGCTTTTGTTTCTTAA-3' | (SEQ ID NO: 7121) |
| KRAS-2048 Target: | 5'-GCATTGCTTTTGTTTCTTAAG-3' | (SEQ ID NO: 7122) |
| KRAS-2054 Target: | 5'-CTTTTGTTTCTTAAGAAAACA-3' | (SEQ ID NO: 7123) |
| KRAS-2061 Target: | 5'-TTCTTAAGAAAACAAACTCTT-3' | (SEQ ID NO: 7124) |
| KRAS-2062 Target: | 5'-TCTTAAGAAAACAAACTCTTT-3' | (SEQ ID NO: 7125) |
| KRAS-2063 Target: | 5'-CTTAAGAAAACAAACTCTTTT-3' | (SEQ ID NO: 7126) |
| KRAS-2064 Target: | 5'-TTAAGAAAACAAACTCTTTTT-3' | (SEQ ID NO: 7127) |
| KRAS-2065 Target: | 5'-TAAGAAAACAAACTCTTTTTT-3' | (SEQ ID NO: 7128) |
| KRAS-2066 Target: | 5'-AAGAAAACAAACTCTTTTTTA-3' | (SEQ ID NO: 7129) |
| KRAS-2067 Target: | 5'-AGAAAACAAACTCTTTTTTAA-3' | (SEQ ID NO: 7130) |
| KRAS-2071 Target: | 5'-AACAAACTCTTTTTTAAAAAT-3' | (SEQ ID NO: 7131) |
| KRAS-2077 Target: | 5'-CTCTTTTTTAAAAATTACTTT-3' | (SEQ ID NO: 7132) |
| KRAS-2078 Target: | 5'-TCTTTTTTAAAAATTACTTTT-3' | (SEQ ID NO: 7133) |
| KRAS-2079 Target: | 5'-CTTTTTTAAAAATTACTTTTA-3' | (SEQ ID NO: 7134) |
| KRAS-2080 Target: | 5'-TTTTTTAAAAATTACTTTTAA-3' | (SEQ ID NO: 7135) |
| KRAS-2081 Target: | 5'-TTTTTAAAAATTACTTTTAAA-3' | (SEQ ID NO: 7136) |
| KRAS-2082 Target: | 5'-TTTTAAAAATTACTTTTAAAT-3' | (SEQ ID NO: 7137) |
| KRAS-2083 Target: | 5'-TTTAAAAATTACTTTTAAATA-3' | (SEQ ID NO: 7138) |
| KRAS-2084 Target: | 5'-TTAAAAATTACTTTTAAATAT-3' | (SEQ ID NO: 7139) |
| KRAS-2085 Target: | 5'-TAAAAATTACTTTTAAATATT-3' | (SEQ ID NO: 7140) |
| KRAS-2092 Target: | 5'-TACTTTTAAATATTAACTCAA-3' | (SEQ ID NO: 7141) |
| KRAS-2093 Target: | 5'-ACTTTTAAATATTAACTCAAA-3' | (SEQ ID NO: 7142) |
| KRAS-2095 Target: | 5'-TTTTAAATATTAACTCAAAAG-3' | (SEQ ID NO: 7143) |
| KRAS-2097 Target: | 5'-TTAAATATTAACTCAAAAGTT-3' | (SEQ ID NO: 7144) |
| KRAS-2098 Target: | 5'-TAAATATTAACTCAAAAGTTG-3' | (SEQ ID NO: 7145) |
| KRAS-2099 Target: | 5'-AAATATTAACTCAAAAGTTGA-3' | (SEQ ID NO: 7146) |
| KRAS-2100 Target: | 5'-AATATTAACTCAAAAGTTGAG-3' | (SEQ ID NO: 7147) |
| KRAS-2134 Target: | 5'-GGTGTGCCAAGACATTAATTT-3' | (SEQ ID NO: 7148) |
| KRAS-2139 Target: | 5'-GCCAAGACATTAATTTTTTT-3' | (SEQ ID NO: 7149) |
| KRAS-2140 Target: | 5'-CCAAGACATTAATTTTTTTT-3' | (SEQ ID NO: 7150) |
| KRAS-2146 Target: | 5'-CATTAATTTTTTTTAAACA-3' | (SEQ ID NO: 7151) |
| KRAS-2147 Target: | 5'-ATTAATTTTTTTTAAACAA-3' | (SEQ ID NO: 7152) |
| KRAS-2149 Target: | 5'-TAATTTTTTTTTAAACAATG-3' | (SEQ ID NO: 7153) |
| KRAS-2151 Target: | 5'-ATTTTTTTTTAAACAATGAA-3' | (SEQ ID NO: 7154) |

TABLE 7 -continued

DsiRNA Target Sequences (21 mers)

| | | |
|---|---|---|
| KRAS-2152 Target: | 5'-TTTTTTTTTAAACAATGAAG-3' | (SEQ ID NO: 7155) |
| KRAS-2153 Target: | 5'-TTTTTTTTAAACAATGAAGT-3' | (SEQ ID NO: 7156) |
| KRAS-2154 Target: | 5'-TTTTTTTAAACAATGAAGTG-3' | (SEQ ID NO: 7157) |
| KRAS-2155 Target: | 5'-TTTTTTAAACAATGAAGTGA-3' | (SEQ ID NO: 7158) |
| KRAS-2157 Target: | 5'-TTTTAAACAATGAAGTGAAA-3' | (SEQ ID NO: 7159) |
| KRAS-2158 Target: | 5'-TTTAAACAATGAAGTGAAAA-3' | (SEQ ID NO: 7160) |
| KRAS-2159 Target: | 5'-TTAAACAATGAAGTGAAAAA-3' | (SEQ ID NO: 7161) |
| KRAS-2167 Target: | 5'-ATGAAGTGAAAAGTTTTACA-3' | (SEQ ID NO: 7162) |
| KRAS-2173 Target: | 5'-TGAAAAGTTTTACAATCTCT-3' | (SEQ ID NO: 7163) |
| KRAS-2174 Target: | 5'-GAAAAGTTTTACAATCTCTA-3' | (SEQ ID NO: 7164) |
| KRAS-2175 Target: | 5'-AAAAGTTTTACAATCTCTAG-3' | (SEQ ID NO: 7165) |
| KRAS-2216 Target: | 5'-ACTGGTTAAATTAACATTGCA-3' | (SEQ ID NO: 7166) |
| KRAS-2217 Target: | 5'-CTGGTTAAATTAACATTGCAT-3' | (SEQ ID NO: 7167) |
| KRAS-2218 Target: | 5'-TGGTTAAATTAACATTGCATA-3' | (SEQ ID NO: 7168) |
| KRAS-2229 Target: | 5'-ACATTGCATAAACACTTTTCA-3' | (SEQ ID NO: 7169) |
| KRAS-2247 Target: | 5'-TCAAGTCTGATCCATATTTAA-3' | (SEQ ID NO: 7170) |
| KRAS-2257 Target: | 5'-TCCATATTTAATAATGCTTTA-3' | (SEQ ID NO: 7171) |
| KRAS-2258 Target: | 5'-CCATATTTAATAATGCTTTAA-3' | (SEQ ID NO: 7172) |
| KRAS-2259 Target: | 5'-CATATTTAATAATGCTTTAAA-3' | (SEQ ID NO: 7173) |
| KRAS-2260 Target: | 5'-ATATTTAATAATGCTTTAAAA-3' | (SEQ ID NO: 7174) |
| KRAS-2261 Target: | 5'-TATTTAATAATGCTTTAAAAT-3' | (SEQ ID NO: 7175) |
| KRAS-2262 Target: | 5'-ATTTAATAATGCTTTAAAATA-3' | (SEQ ID NO: 7176) |
| KRAS-2264 Target: | 5'-TTAATAATGCTTTAAAATAAA-3' | (SEQ ID NO: 7177) |
| KRAS-2265 Target: | 5'-TAATAATGCTTTAAAATAAAA-3' | (SEQ ID NO: 7178) |
| KRAS-2266 Target: | 5'-AATAATGCTTTAAAATAAAAA-3' | (SEQ ID NO: 7179) |
| KRAS-2267 Target: | 5'-ATAATGCTTTAAAATAAAAAT-3' | (SEQ ID NO: 7180) |
| KRAS-2274 Target: | 5'-TTTAAAATAAAAATAAAAACA-3' | (SEQ ID NO: 7181) |
| KRAS-2280 Target: | 5'-ATAAAAATAAAAACAATCCTT-3' | (SEQ ID NO: 7182) |
| KRAS-2281 Target: | 5'-TAAAAATAAAAACAATCCTTT-3' | (SEQ ID NO: 7183) |
| KRAS-2282 Target: | 5'-AAAAATAAAAACAATCCTTTT-3' | (SEQ ID NO: 7184) |
| KRAS-2283 Target: | 5'-AAAATAAAAACAATCCTTTTG-3' | (SEQ ID NO: 7185) |
| KRAS-2284 Target: | 5'-AAATAAAAACAATCCTTTTGA-3' | (SEQ ID NO: 7186) |
| KRAS-2285 Target: | 5'-AATAAAAACAATCCTTTTGAT-3' | (SEQ ID NO: 7187) |
| KRAS-2286 Target: | 5'-ATAAAAACAATCCTTTTGATA-3' | (SEQ ID NO: 7188) |
| KRAS-2287 Target: | 5'-TAAAAACAATCCTTTTGATAA-3' | (SEQ ID NO: 7189) |
| KRAS-2291 Target: | 5'-AACAATCCTTTTGATAAATTT-3' | (SEQ ID NO: 7190) |
| KRAS-2296 Target: | 5'-TCCTTTTGATAAATTTAAAAT-3' | (SEQ ID NO: 7191) |
| KRAS-2297 Target: | 5'-CCTTTTGATAAATTTAAAATG-3' | (SEQ ID NO: 7192) |
| KRAS-2298 Target: | 5'-CTTTTGATAAATTTAAAATGT-3' | (SEQ ID NO: 7193) |

TABLE 7 -continued

| DsiRNA Target Sequences (21 mers) | | |
|---|---|---|
| KRAS-2302 Target: 5'-TGATAAATTTAAAATGTTACT-3' | (SEQ ID NO: 7194) |
| KRAS-2303 Target: 5'-GATAAATTTAAAATGTTACTT-3' | (SEQ ID NO: 7195) |
| KRAS-2304 Target: 5'-ATAAATTTAAAATGTTACTTA-3' | (SEQ ID NO: 7196) |
| KRAS-2305 Target: 5'-TAAATTTAAAATGTTACTTAT-3' | (SEQ ID NO: 7197) |
| KRAS-2306 Target: 5'-AAATTTAAAATGTTACTTATT-3' | (SEQ ID NO: 7198) |
| KRAS-2307 Target: 5'-AATTTAAAATGTTACTTATTT-3' | (SEQ ID NO: 7199) |
| KRAS-2309 Target: 5'-TTTAAAATGTTACTTATTTTA-3' | (SEQ ID NO: 7200) |
| KRAS-2310 Target: 5'-TTAAAATGTTACTTATTTTAA-3' | (SEQ ID NO: 7201) |
| KRAS-2311 Target: 5'-TAAAATGTTACTTATTTTAAA-3' | (SEQ ID NO: 7202) |
| KRAS-2312 Target: 5'-AAAATGTTACTTATTTTAAAA-3' | (SEQ ID NO: 7203) |
| KRAS-2313 Target: 5'-AAATGTTACTTATTTTAAAAT-3' | (SEQ ID NO: 7204) |
| KRAS-2315 Target: 5'-ATGTTACTTATTTTAAAATAA-3' | (SEQ ID NO: 7205) |
| KRAS-2320 Target: 5'-ACTTATTTTAAAATAAATGAA-3' | (SEQ ID NO: 7206) |
| KRAS-2322 Target: 5'-TTATTTTAAAATAAATGAAGT-3' | (SEQ ID NO: 7207) |
| KRAS-2323 Target: 5'-TATTTTAAAATAAATGAAGTG-3' | (SEQ ID NO: 7208) |
| KRAS-2326 Target: 5'-TTTAAAATAAATGAAGTGAGA-3' | (SEQ ID NO: 7209) |
| KRAS-2327 Target: 5'-TTAAAATAAATGAAGTGAGAT-3' | (SEQ ID NO: 7210) |
| KRAS-2447 Target: 5'-TCCATTTCTTCATGTTAAAAG-3' | (SEQ ID NO: 7211) |
| KRAS-2448 Target: 5'-CCATTTCTTCATGTTAAAAGA-3' | (SEQ ID NO: 7212) |
| KRAS-2475 Target: 5'-CTCAAACTCTTAGTTTTTTTT-3' | (SEQ ID NO: 7213) |
| KRAS-2485 Target: 5'-TAGTTTTTTTTTTTACAACT-3' | (SEQ ID NO: 7214) |
| KRAS-2486 Target: 5'-AGTTTTTTTTTTTACAACTA-3' | (SEQ ID NO: 7215) |
| KRAS-2487 Target: 5'-GTTTTTTTTTTTACAACTAT-3' | (SEQ ID NO: 7216) |
| KRAS-2488 Target: 5'-TTTTTTTTTTTACAACTATG-3' | (SEQ ID NO: 7217) |
| KRAS-2489 Target: 5'-TTTTTTTTTTACAACTATGT-3' | (SEQ ID NO: 7218) |
| KRAS-2490 Target: 5'-TTTTTTTTTACAACTATGTA-3' | (SEQ ID NO: 7219) |
| KRAS-2491 Target: 5'-TTTTTTTTACAACTATGTAA-3' | (SEQ ID NO: 7220) |
| KRAS-2492 Target: 5'-TTTTTTTACAACTATGTAAT-3' | (SEQ ID NO: 7221) |
| KRAS-2493 Target: 5'-TTTTTTACAACTATGTAATT-3' | (SEQ ID NO: 7222) |
| KRAS-2494 Target: 5'-TTTTTACAACTATGTAATTT-3' | (SEQ ID NO: 7223) |
| KRAS-2495 Target: 5'-TTTTACAACTATGTAATTTA-3' | (SEQ ID NO: 7224) |
| KRAS-2502 Target: 5'-AACTATGTAATTTATATTCCA-3' | (SEQ ID NO: 7225) |
| KRAS-2503 Target: 5'-ACTATGTAATTTATATTCCAT-3' | (SEQ ID NO: 7226) |
| KRAS-2504 Target: 5'-CTATGTAATTTATATTCCATT-3' | (SEQ ID NO: 7227) |
| KRAS-2510 Target: 5'-AATTTATATTCCATTTACATA-3' | (SEQ ID NO: 7228) |
| KRAS-2511 Target: 5'-ATTTATATTCCATTTACATAA-3' | (SEQ ID NO: 7229) |
| KRAS-2512 Target: 5'-TTTATATTCCATTTACATAAG-3' | (SEQ ID NO: 7230) |
| KRAS-2513 Target: 5'-TTATATTCCATTTACATAAGG-3' | (SEQ ID'NO: 7231) |
| KRAS-2525 Target: 5'-TACATAAGGATACACTTATTT-3' | (SEQ ID NO: 7232) |

TABLE 7 -continued

| DsiRNA Target Sequences (21 mers) | | |
|---|---|---|
| KRAS-2529 Target: | 5'-TAAGGATACACTTATTTGTCA-3' | (SEQ ID NO: 7233) |
| KRAS-2561 Target: | 5'-ATCTGTAAATTTTTAACCTAT-3' | (SEQ ID NO: 7234) |
| KRAS-2562 Target: | 5'-TCTGTAAATTTTTAACCTATG-3' | (SEQ ID NO: 7235) |
| KRAS-2563 Target: | 5'-CTGTAAATTTTTAACCTATGT-3' | (SEQ ID NO: 7236) |
| KRAS-2619 Target: | 5'-TGCAAGAGGTGAAGTTTATAT-3' | (SEQ ID NO: 7237) |
| KRAS-2621 Target: | 5'-CAAGAGGTGAAGTTTATATTT-3' | (SEQ ID NO: 7238) |
| KRAS-2622 Target: | 5'-AAGAGGTGAAGTTTATATTTG-3' | (SEQ ID NO: 7239) |
| KRAS-2624 Target: | 5'-GAGGTGAAGTTTATATTTGAA-3' | (SEQ ID NO: 7240) |
| KRAS-2625 Target: | 5'-AGGTGAAGTTTATATTTGAAT-3' | (SEQ ID NO: 7241) |
| KRAS-2630 Target: | 5'-AAGTTTATATTTGAATATCCA-3' | (SEQ ID NO: 7242) |
| KRAS-2718 Target: | 5'-ACTTGATGCAGTTTTAATACT-3' | (SEQ ID NO: 7243) |
| KRAS-2720 Target: | 5'-TTGATGCAGTTTTAATACTTG-3' | (SEQ ID NO: 7244) |
| KRAS-2871 Target: | 5'-GATTTGACCTAATCACTAATT-3' | (SEQ ID NO: 7245) |
| KRAS-2877 Target: | 5'-ACCTAATCACTAATTTTCAGG-3' | (SEQ ID NO: 7246) |
| KRAS-2946 Target: | 5'-CAGTAGGATTTTCAAACCTG-3' | (SEQ ID NO: 7247) |
| KRAS-2991 Target: | 5'-AGTGGAAGGAGAATTTAATAA-3' | (SEQ ID NO: 7248) |
| KRAS-2994 Target: | 5'-GGAAGGAGAATTTAATAAAGA-3' | (SEQ ID NO: 7249) |
| KRAS-2996 Target: | 5'-AAGGAGAATTTAATAAAGATA-3' | (SEQ ID NO: 7250) |
| KRAS-2997 Target: | 5'-AGGAGAATTTAATAAAGATAG-3' | (SEQ ID NO: 7251) |
| KRAS-3001 Target: | 5'-GAATTTAATAAAGATAGTGCT-3' | (SEQ ID NO: 7252) |
| KRAS-3030 Target: | 5'-TCCTTAGGTAATCTATAACTA-3' | (SEQ ID NO: 7253) |
| KRAS-3031 Target: | 5'-CCTTAGGTAATCTATAACTAG-3' | (SEQ ID NO: 7254) |
| KRAS-3065 Target: | 5'-AACAGTAATACATTCCATTGT-3' | (SEQ ID NO: 7255) |
| KRAS-3067 Target: | 5'-CAGTAATACATTCCATTGTTT-3' | (SEQ ID NO: 7256) |
| KRAS-3068 Target: | 5'-AGTAATACATTCCATTGTTTT-3' | (SEQ ID NO: 7257) |
| KRAS-3069 Target: | 5'-GTAATACATTCCATTGTTTTA-3' | (SEQ ID NO: 7258) |
| KRAS-3079 Target: | 5'-CCATTGTTTTAGTAACCAGAA-3' | (SEQ ID NO: 7259) |
| KRAS-3093 Target: | 5'-ACCAGAAATCTTCATGCAATG-3' | (SEQ ID NO: 7260) |
| KRAS-3103 Target: | 5'-TTCATGCAATGAAAAATACTT-3' | (SEQ ID NO: 7261) |
| KRAS-3110 Target: | 5'-AATGAAAAATACTTTAATTCA-3' | (SEQ ID NO: 7262) |
| KRAS-3112 Target: | 5'-TGAAAAATACTTTAATTCATG-3' | (SEQ ID NO: 7263) |
| KRAS-3113 Target: | 5'-GAAAAATACTTTAATTCATGA-3' | (SEQ ID NO: 7264) |
| KRAS-3127 Target: | 5'-TTCATGAAGCTTACTTTTTTT-3' | (SEQ ID NO: 7265) |
| KRAS-3130 Target: | 5'-ATGAAGCTTACTTTTTTTTT-3' | (SEQ ID NO: 7266) |
| KRAS-3134 Target: | 5'-AGCTTACTTTTTTTTTTGGT-3' | (SEQ ID NO: 7267) |
| KRAS-3138 Target: | 5'-TACTTTTTTTTTTGGTGTCA-3' | (SEQ ID NO: 7268) |
| KRAS-3139 Target: | 5'-ACTTTTTTTTTTGGTGTCAG-3' | (SEQ ID NO: 7269) |
| KRAS-3297 Target: | 5'-AACTAATTTTGTATTTTTAG-3' | (SEQ ID NO: 7270) |
| KRAS-3300 Target: | 5'-TAATTTTTGTATTTTTAGGAG-3' | (SEQ ID NO: 7271) |

TABLE 7 -continued

| DsiRNA Target Sequences (21 mers) | | |
|---|---|---|
| KRAS-3413 Target: | 5'-CTCATTTATTCAGCAAATATT-3' | (SEQ ID NO: 7272) |
| KRAS-3415 Target: | 5'-CATTTATTCAGCAAATATTTA-3' | (SEQ ID NO: 7273) |
| KRAS-3417 Target: | 5'-TTTATTCAGCAAATATTTATT-3' | (SEQ ID NO: 7274) |
| KRAS-3589 Target: | 5'-TATTTTAGTTTTGCAAAGAAG-3' | (SEQ ID NO: 7275) |
| KRAS-3630 Target: | 5'-CTCTATAATTGTTTTGCTACG-3' | (SEQ ID NO: 7276) |
| KRAS-3677 Target: | 5'-TACTTTATGTAAATCACTTCA-3' | (SEQ ID NO: 7277) |
| KRAS-3678 Target: | 5'-ACTTTATGTAAATCACTTCAT-3' | (SEQ ID NO: 7278) |
| KRAS-3679 Target: | 5'-CTTTATGTAAATCACTTCATT-3' | (SEQ ID NO: 7279) |
| KRAS-3680 Target: | 5'-TTTATGTAAATCACTTCATTG-3' | (SEQ ID NO: 7280) |
| KRAS-3681 Target: | 5'-TTATGTAAATCACTTCATTGT-3' | (SEQ ID NO: 7281) |
| KRAS-3682 Target: | 5'-TATGTAAATCACTTCATTGTT-3' | (SEQ ID NO: 7282) |
| KRAS-3683 Target: | 5'-ATGTAAATCACTTCATTGTTT-3' | (SEQ ID NO: 7283) |
| KRAS-3697 Target: | 5'-ATTGTTTTAAAGGAATAAACT-3' | (SEQ ID NO: 7284) |
| KRAS-3698 Target: | 5'-TTGTTTTAAAGGAATAAACTT-3' | (SEQ ID NO: 7285) |
| KRAS-3701 Target: | 5'-TTTTAAAGGAATAAACTTGAT-3' | (SEQ ID NO: 7286) |
| KRAS-3702 Target: | 5'-TTTAAAGGAATAAACTTGATT-3' | (SEQ ID NO: 7287) |
| KRAS-3703 Target: | 5'-TTAAAGGAATAAACTTGATTA-3' | (SEQ ID NO: 7288) |
| KRAS-3705 Target: | 5'-AAAGGAATAAACTTGATTATA-3' | (SEQ ID NO: 7289) |
| KRAS-3706 Target: | 5'-AAGGAATAAACTTGATTATAT-3' | (SEQ ID NO: 7290) |
| KRAS-3707 Target: | 5'-AGGAATAAACTTGATTATATT-3' | (SEQ ID NO: 7291) |
| KRAS-3708 Target: | 5'-GGAATAAACTTGATTATATTG-3' | (SEQ ID NO: 7292) |
| KRAS-3709 Target: | 5'-GAATAAACTTGATTATATTGT-3' | (SEQ ID NO: 7293) |
| KRAS-3714 Target: | 5'-AACTTGATTATATTGTTTTTT-3' | (SEQ ID NO: 7294) |
| KRAS-3715 Target: | 5'-ACTTGATTATATTGTTTTTTT-3' | (SEQ ID NO: 7295) |
| KRAS-3718 Target: | 5'-TGATTATATTGTTTTTTTATT-3' | (SEQ ID NO: 7296) |
| KRAS-3723 Target: | 5'-ATATTGTTTTTTATTTGGCA-3' | (SEQ ID NO: 7297) |
| KRAS-3724 Target: | 5'-TATTGTTTTTTTATTTGGCAT-3' | (SEQ ID NO: 7298) |
| KRAS-3728 Target: | 5'-GTTTTTTTATTTGGCATAACT-3' | (SEQ ID NO: 7299) |
| KRAS-3729 Target: | 5'-TTTTTTTATTTGGCATAACTG-3' | (SEQ ID NO: 7300) |
| KRAS-3741 Target: | 5'-GCATAACTGTGATTCTTTTAG-3' | (SEQ ID NO: 7301) |
| KRAS-3746 Target: | 5'-ACTGTGATTCTTTTAGGACAA-3' | (SEQ ID NO: 7302) |
| KRAS-3747 Target: | 5'-CTGTGATTCTTTTAGGACAAT-3' | (SEQ ID NO: 7303) |
| KRAS-3783 Target: | 5'-GGTGTATGTCAGATATTCATA-3' | (SEQ ID NO: 7304) |
| KRAS-3784 Target: | 5'-GTGTATGTCAGATATTCATAT-3' | (SEQ ID NO: 7305) |
| KRAS-3810 Target: | 5'-CAAATGTGTAATATTCCAGTT-3' | (SEQ ID NO: 7306) |
| KRAS-3838 Target: | 5'-CATAAGTAATTAAAATATACT-3' | (SEQ ID NO: 7307) |
| KRAS-3839 Target: | 5'-ATAAGTAATTAAAATATACTT-3' | (SEQ ID NO: 7308) |
| KRAS-3840 Target: | 5'-TAAGTAATTAAAATATACTTA-3' | (SEQ ID NO: 7309) |
| KRAS-3841 Target: | 5'-AAGTAATTAAAATATACTTAA-3' | (SEQ ID NO: 7310) |

TABLE 7-continued

| DsiRNA Target Sequences (21 mers) |
| --- |

KRAS-3842 Target: 5'-AGTAATTAAAATATACTTAAA-3'  (SEQ ID NO: 7311)

KRAS-3843 Target: 5'-GTAATTAAAATATACTTAAAA-3'  (SEQ ID NO: 7312)

KRAS-3844 Target: 5'-TAATTAAAATATACTTAAAAA-3'  (SEQ ID NO: 7313)

KRAS-3845 Target: 5'-AATTAAAATATACTTAAAAAT-3'  (SEQ ID NO: 7314)

KRAS-3846 Target: 5'-ATTAAAATATACTTAAAAATT-3'  (SEQ ID NO: 7315)

KRAS-3848 Target: 5'-TAAAATATACTTAAAAATTAA-3'  (SEQ ID NO: 7316)

KRAS-3849 Target: 5'-AAAATATACTTAAAAATTAAT-3'  (SEQ ID NO: 7317)

KRAS-3850 Target: 5'-AAATATACTTAAAAATTAATA-3'  (SEQ ID NO: 7318)

KRAS-3851 Target: 5'-AATATACTTAAAAATTAATAG-3'  (SEQ ID NO: 7319)

KRAS-3855 Target: 5'-TACTTAAAAATTAATAGTTTT-3'  (SEQ ID NO: 7320)

KRAS-3859 Target: 5'-TAAAAATTAATAGTTTTATCT-3'  (SEQ ID NO: 7321)

KRAS-3860 Target: 5'-AAAAATTAATAGTTTTATCTG-3'  (SEQ ID NO: 7322)

KRAS-3861 Target: 5'-AAAATTAATAGTTTTATCTGG-3'  (SEQ ID NO: 7323)

KRAS-3876 Target: 5'-ATCTGGGTACAAATAAACAGG-3'  (SEQ ID NO: 7324)

KRAS-3915 Target: 5'-GACAAGGAAACTTCTATGTAA-3'  (SEQ ID NO: 7325)

KRAS-3916 Target: 5'-ACAAGGAAACTTCTATGTAAA-3'  (SEQ ID NO: 7326)

KRAS-3917 Target: 5'-CAAGGAAACTTCTATGTAAAA-3'  (SEQ ID NO: 7327)

KRAS-3926 Target: 5'-TTCTATGTAAAAATCACTATG-3'  (SEQ ID NO: 7328)

KRAS-3927 Target: 5'-TCTATGTAAAAATCACTATGA-3'  (SEQ ID NO: 7329)

KRAS-3928 Target: 5'-CTATGTAAAAATCACTATGAT-3'  (SEQ ID NO: 7330)

KRAS-3932 Target: 5'-GTAAAAATCACTATGATTTCT-3'  (SEQ ID NO: 7331)

KRAS-3933 Target: 5'-TAAAAATCACTATGATTTCTG-3'  (SEQ ID NO: 7332)

KRAS-3942 Target: 51-CTATGATTTCTGAATTGCTAT-3'  (SEQ ID NO: 7333)

KRAS-3943 Target: 5'-TATGATTTCTGAATTGCTATG-3'  (SEQ ID NO: 7334)

KRAS-3960 Target: 5'-TATGTGAAACTACAGATCTTT-3'  (SEQ ID NO: 7335)

KRAS-3961 Target: 5'-ATGTGAAACTACAGATCTTTG-3'  (SEQ ID NO: 7336)

KRAS-3997 Target: 5'-AGGGTGTTAAGACTTACACAG-3'  (SEQ ID NO: 7337)

KRAS-4084 Target: 5'-TTTAGGCCTCTTGAATTTTTG-3'  (SEQ ID NO: 7338)

KRAS-4092 Target: 5'-TCTTGAATTTTTGATGTAGAT-3'  (SEQ ID NO: 7339)

KRAS-4093 Target: 5'-CTTGAATTTTTGATGTAGATG-3'  (SEQ ID NO: 7340)

KRAS-4108 Target: 5'-TAGATGGGCATTTTTTAAGG-3'  (SEQ ID NO: 7341)

KRAS-4114 Target: 5'-GGCATTTTTTAAGGTAGTGG-3'  (SEQ ID NO: 7342)

KRAS-4126 Target: 5'-AGGTAGTGGTTAATTACCTTT-3'  (SEQ ID NO: 7343)

KRAS-4128 Target: 5'-GTAGTGGTTAATTACCTTTAT-3'  (SEQ ID NO: 7344)

KRAS-4129 Target: 5'-TAGTGGTTAATTACCTTTATG-3'  (SEQ ID NO: 7345)

KRAS-4130 Target: 5'-AGTGGTTAATTACCTTTATGT-3'  (SEQ ID NO: 7346)

KRAS-4131 Target: 5'-GTGGTTAATTACCTTTATGTG-3'  (SEQ ID NO: 7347)

KRAS-4141 Target: 5'-ACCTTTATGTGAACTTTGAAT-3'  (SEQ ID NO: 7348)

KRAS-4146 Target: 5'-TATGTGAACTTTGAATGGTTT-3'  (SEQ ID NO: 7349)

TABLE 7 -continued

| DsiRNA Target Sequences (21 mers) | | |
|---|---|---|
| KRAS-4152 Target: | 5'-AACTTTGAATGGTTTAACAAA-3' | (SEQ ID NO: 7350) |
| KRAS-4156 Target: | 5'-TTGAATGGTTTAACAAAAGAT-3' | (SEQ ID NO: 7351) |
| KRAS-4157 Target: | 5'-TGAATGGTTTAACAAAAGATT-3' | (SEQ ID NO: 7352) |
| KRAS-4158 Target: | 5'-GAATGGTTTAACAAAAGATTT-3' | (SEQ ID NO: 7353) |
| KRAS-4159 Target: | 5'-AATGGTTTAACAAAAGATTTG-3' | (SEQ ID NO: 7354) |
| KRAS-4160 Target: | 5'-ATGGTTTAACAAAAGATTTGT-3' | (SEQ ID NO: 7355) |
| KRAS-4162 Target: | 5'-GGTTTAACAAAAGATTTGTTT-3' | (SEQ ID NO: 7356) |
| KRAS-4163 Target: | 5'-GTTTAACAAAAGATTTGTTTT-3' | (SEQ ID NO: 7357) |
| KRAS-4167 Target: | 5'-AACAAAAGATTTGTTTTGTA-3' | (SEQ ID NO: 7358) |
| KRAS-4168 Target: | 5'-ACAAAAGATTTGTTTTGTAG-3' | (SEQ ID NO: 7359) |
| KRAS-4169 Target: | 5'-CAAAAGATTTGTTTTGTAGA-3' | (SEQ ID NO: 7360) |
| KRAS-4171 Target: | 5'-AAAGATTTGTTTTGTAGAGA-3' | (SEQ ID NO: 7361) |
| KRAS-4172 Target: | 5'-AAGATTTGTTTTGTAGAGAT-3' | (SEQ ID NO: 7362) |
| KRAS-4173 Target: | 5'-AGATTTGTTTTGTAGAGATT-3' | (SEQ ID NO: 7363) |
| KRAS-4174 Target: | 5'-GATTTGTTTTGTAGAGATTT-3' | (SEQ ID NO: 7364) |
| KRAS-4180 Target: | 5'-TTTTTGTAGAGATTTTAAAGG-3' | (SEQ ID NO: 7365) |
| KRAS-4197 Target: | 5'-AAGGGGGAGAATTCTAGAAAT-3' | (SEQ ID NO: 7366) |
| KRAS-4199 Target: | 5'-GGGGGAGAATTCTAGAAATAA-3' | (SEQ ID NO: 7367) |
| KRAS-4200 Target: | 5'-GGGGAGAATTCTAGAAATAAA-3' | (SEQ ID NO: 7368) |
| KRAS-4201 Target: | 5'-GGGAGAATTCTAGAAATAAAT-3' | (SEQ ID NO: 7369) |
| KRAS-4202 Target: | 5'-GGAGAATTCTAGAAATAAATG-3' | (SEQ ID NO: 7370) |
| KRAS-4203 Target: | 5'-GAGAATTCTAGAAATAAATGT-3' | (SEQ ID NO: 7371) |
| KRAS-4208 Target: | 5'-TTCTAGAAATAAATGTTACCT-3' | (SEQ ID NO: 7372) |
| KRAS-4209 Target: | 5'-TCTAGAAATAAATGTTACCTA-3' | (SEQ ID NO: 7373) |
| KRAS-4210 Target: | 5'-CTAGAAATAAATGTTACCTAA-3' | (SEQ ID NO: 7374) |
| KRAS-4211 Target: | 5'-TAGAAATAAATGTTACCTAAT-3' | (SEQ ID NO: 7375) |
| KRAS-4212 Target: | 5'-AGAAATAAATGTTACCTAATT-3' | (SEQ ID NO: 7376) |
| KRAS-4214 Target: | 5'-AAATAAATGTTACCTAATTAT-3' | (SEQ ID NO: 7377) |
| KRAS-4225 Target: | 5'-ACCTAATTATTACAGCCTTAA-3' | (SEQ ID NO: 7378) |
| KRAS-4226 Target: | 5'-CCTAATTATTACAGCCTTAAA-3' | (SEQ ID NO: 7379) |
| KRAS-4240 Target: | 5'-CCTTAAAGACAAAAATCCTTG-3' | (SEQ ID NO: 7380) |
| KRAS-4243 Target: | 5'-TAAAGACAAAAATCCTTGTTG-3' | (SEQ ID NO: 7381) |
| KRAS-4255 Target: | 5'-TCCTTGTTGAAGTTTTTTAA-3' | (SEQ ID NO: 7382) |
| KRAS-4256 Target: | 5'-CCTTGTTGAAGTTTTTTAAA-3' | (SEQ ID NO: 7383) |
| KRAS-4258 Target: | 5'-TTGTTGAAGTTTTTTAAAAA-3' | (SEQ ID NO: 7384) |
| KRAS-4259 Target: | 5'-TGTTGAAGTTTTTTAAAAAA-3' | (SEQ ID NO: 7385) |
| KRAS-4263 Target: | 5'-GAAGTTTTTTAAAAAAAGCT-3' | (SEQ ID NO: 7386) |
| KRAS-4264 Target: | 5'-AAGTTTTTTAAAAAAAGCTA-3' | (SEQ ID NO: 7387) |
| KRAS-4265 Target: | 5'-AGTTTTTTAAAAAAAGCTAA-3' | (SEQ ID NO: 7388) |

TABLE 7 -continued

| DsiRNA Target Sequences (21 mers) | | |
|---|---|---|
| KRAS-4266 Target: | 5'-GTTTTTTTAAAAAAAGCTAAA-3' | (SEQ ID NO: 7389) |
| KRAS-4267 Target: | 5'-TTTTTTTAAAAAAAGCTAAAT-3' | (SEQ ID NO: 7390) |
| KRAS-4271 Target: | 5'-TTTAAAAAAAGCTAAATTACA-3' | (SEQ ID NO: 7391) |
| KRAS-4273 Target: | 5'-TAAAAAAAGCTAAATTACATA-3' | (SEQ ID NO: 7392) |
| KRAS-4295 Target: | 5'-ACTTAGGCATTAACATGTTTG-3' | (SEQ ID NO: 7393) |
| KRAS-4296 Target: | 5'-CTTAGGCATTAACATGTTTGT-3' | (SEQ ID NO: 7394) |
| KRAS-4327 Target: | 5'-AGCAGACGTATATTGTATCAT-3' | (SEQ ID NO: 7395) |
| KRAS-4331 Target: | 5'-GACGTATATTGTATCATTTGA-3' | (SEQ ID NO: 7396) |
| KRAS-4333 Target: | 5'-CGTATATTGTATCATTTGAGT-3' | (SEQ ID NO: 7397) |
| KRAS-4336 Target: | 5'-ATATTGTATCATTTGAGTGAA-3' | (SEQ ID NO: 7398) |
| KRAS-4337 Target: | 5'-TATTGTATCATTTGAGTGAAT-3' | (SEQ ID NO: 7399) |
| KRAS-4338 Target: | 5'-ATTGTATCATTTGAGTGAATG-3' | (SEQ ID NO: 7400) |
| KRAS-4404 Target: | 5'-ATAGGAATTTAGAACCTAACT-3' | (SEQ ID NO: 7401) |
| KRAS-4405 Target: | 5'-TAGGAATTTAGAACCTAACTT-3' | (SEQ ID NO: 7402) |
| KRAS-4409 Target: | 5'-AATTTAGAACCTAACTTTTAT-3' | (SEQ ID NO: 7403) |
| KRAS-4410 Target: | 5'-ATTTAGAACCTAACTTTTATA-3' | (SEQ ID NO: 7404) |
| KRAS-4411 Target: | 5'-TTTAGAACCTAACTTTTATAG-3' | (SEQ ID NO: 7405) |
| KRAS-4412 Target: | 5'-TTAGAACCTAACTTTTATAGG-3' | (SEQ ID NO: 7406) |
| KRAS-4424 Target: | 5'-TTTTATAGGTTATCAAAACTG-3' | (SEQ ID NO: 7407) |
| KRAS-4426 Target: | 5'-TTATAGGTTATCAAAACTGTT-3' | (SEQ ID NO: 7408) |
| KRAS-4460 Target: | 5'-AATTTTGTCCTAATATATACA-3' | (SEQ ID NO: 7409) |
| KRAS-4461 Target: | 5'-ATTTTGTCCTAATATATACAT-3' | (SEQ ID NO: 7410) |
| KRAS-4462 Target: | 5'-TTTTGTCCTAATATATACATA-3' | (SEQ ID NO: 7411) |
| KRAS-4468 Target: | 5'-CCTAATATATACATAGAAACT-3' | (SEQ ID NO: 7412) |
| KRAS-4473 Target: | 5'-TATATACATAGAAACTTTGTG-3' | (SEQ ID NO: 7413) |
| KRAS-4516 Target: | 5'-CACAAGTTCATCTCATTTGTA-3' | (SEQ ID NO: 7414) |
| KRAS-4527 Target: | 5'-CTCATTTGTATTCCATTGATT-3' | (SEQ ID NO: 7415) |
| KRAS-4528 Target: | 5'-TCATTTGTATTCCATTGATTT-3' | (SEQ ID NO: 7416) |
| KRAS-4529 Target: | 5'-CATTTGTATTCCATTGATTTT-3' | (SEQ ID NO: 7417) |
| KRAS-4530 Target: | 5'-ATTTGTATTCCATTGATTTTT-3' | (SEQ ID NO: 7418) |
| KRAS-4531 Target: | 5'-TTTGTATTCCATTGATTTTTT-3' | (SEQ ID NO: 7419) |
| KRAS-4532 Target: | 5'-TTGTATTCCATTGATTTTTTT-3' | (SEQ ID NO: 7420) |
| KRAS-4533 Target: | 5'-TGTATTCCATTGATTTTTTTT-3' | (SEQ ID NO: 7421) |
| KRAS-4540 Target: | 5'-CATTGATTTTTTTTCTTCT-3' | (SEQ ID NO: 7422) |
| KRAS-4541 Target: | 5'-ATTGATTTTTTTTCTTCTA-3' | (SEQ ID NO: 7423) |
| KRAS-4545 Target: | 5'-ATTTTTTTTTCTTCTAAACA-3' | (SEQ ID NO: 7424) |
| KRAS-4546 Target: | 5'-TTTTTTTTTCTTCTAAACAT-3' | (SEQ ID NO: 7425) |
| KRAS-4547 Target: | 5'-TTTTTTTTCTTCTAAACATT-3' | (SEQ ID NO: 7426) |
| KRAS-4548 Target: | 5'-TTTTTTTCTTCTAAACATTT-3' | (SEQ ID NO: 7427) |

TABLE 7 -continued

| DsiRNA Target Sequences (21 mers) | | |
|---|---|---|
| KRAS-4549 Target: | 5'-TTTTTTTCTTCTAAACATTTT-3' | (SEQ ID NO: 7428) |
| KRAS-4562 Target: | 5'-AACATTTTTCTTCAAACAGT-3' | (SEQ ID NO: 7429) |
| KRAS-4563 Target: | 5'-ACATTTTTCTTCAAACAGTA-3' | (SEQ ID NO: 7430) |
| KRAS-4564 Target: | 5'-CATTTTTCTTCAAACAGTAT-3' | (SEQ ID NO: 7431) |
| KRAS-4565 Target: | 5'-ATTTTTCTTCAAACAGTATA-3' | (SEQ ID NO: 7432) |
| KRAS-4566 Target: | 5'-TTTTTCTTCAAACAGTATAT-3' | (SEQ ID NO: 7433) |
| KRAS-4573 Target: | 5'-TTCAAACAGTATATAACTTTT-3' | (SEQ ID NO: 7434) |
| KRAS-4578 Target: | 5'-ACAGTATATAACTTTTTTAG-3' | (SEQ ID NO: 7435) |
| KRAS-4579 Target: | 5'-CAGTATATAACTTTTTTAGG-3' | (SEQ ID NO: 7436) |
| KRAS-4580 Target: | 5'-AGTATATAACTTTTTTAGGG-3' | (SEQ ID NO: 7437) |
| KRAS-4581 Target: | 5'-GTATATAACTTTTTTAGGGG-3' | (SEQ ID NO: 7438) |
| KRAS-4587 Target: | 5'-AACTTTTTTAGGGGATTTTT-3' | (SEQ ID NO: 7439) |
| KRAS-4588 Target: | 5'-ACTTTTTTAGGGGATTTTTT-3' | (SEQ ID NO: 7440) |
| KRAS-4599 Target: | 5'-GGGATTTTTTTTAGACAGCA-3' | (SEQ ID NO: 7441) |
| KRAS-4600 Target: | 5'-GGATTTTTTTTAGACAGCAA-3' | (SEQ ID NO: 7442) |
| KRAS-4601 Target: | 5'-GATTTTTTTTAGACAGCAAA-3' | (SEQ ID NO: 7443) |
| KRAS-4629 Target: | 5'-TGAAGATTTCCATTTGTCAAA-3' | (SEQ ID NO: 7444) |
| KRAS-4630 Target: | 5'-GAAGATTTCCATTTGTCAAAA-3' | (SEQ ID NO: 7445) |
| KRAS-4631 Target: | 5'-AAGATTTCCATTTGTCAAAAA-3' | (SEQ ID NO: 7446) |
| KRAS-4632 Target: | 5'-AGATTTCCATTTGTCAAAAAG-3' | (SEQ ID NO: 7447) |
| KRAS-4637 Target: | 5'-TCCATTTGTCAAAAAGTAATG-3' | (SEQ ID NO: 7448) |
| KRAS-4638 Target: | 5'-CCATTTGTCAAAAAGTAATGA-3' | (SEQ ID NO: 7449) |
| KRAS-4639 Target: | 5'-CATTTGTCAAAAAGTAATGAT-3' | (SEQ ID NO: 7450) |
| KRAS-4644 Target: | 5'-GTCAAAAAGTAATGATTTCTT-3' | (SEQ ID NO: 7451) |
| KRAS-4645 Target: | 5'-TCAAAAAGTAATGATTTCTTG-3' | (SEQ ID NO: 7452) |
| KRAS-4646 Target: | 5'-CAAAAAGTAATGATTTCTTGA-3' | (SEQ ID NO: 7453) |
| KRAS-4647 Target: | 5'-AAAAAGTAATGATTTCTTGAT-3' | (SEQ ID NO: 7454) |
| KRAS-4649 Target: | 5'-AAAGTAATGATTTCTTGATAA-3' | (SEQ ID NO: 7455) |
| KRAS-4651 Target: | 5'-AGTAATGATTTCTTGATAATT-3' | (SEQ ID NO: 7456) |
| KRAS-4652 Target: | 5'-GTAATGATTTCTTGATAATTG-3' | (SEQ ID NO: 7457) |
| KRAS-4654 Target: | 5'-AATGATTTCTTGATAATTGTG-3' | (SEQ ID NO: 7458) |
| KRAS-4655 Target: | 5'-ATGATTTCTTGATAATTGTGT-3' | (SEQ ID NO: 7459) |
| KRAS-4660 Target: | 5'-TTCTTGATAATTGTGTAGTAA-3' | (SEQ ID NO: 7460) |
| KRAS-4661 Target: | 5'-TCTTGATAATTGTGTAGTAAT-3' | (SEQ ID NO: 7461) |
| KRAS-4662 Target: | 5'-CTTGATAATTGTGTAGTAATG-3' | (SEQ ID NO: 7462) |
| KRAS-4664 Target: | 5'-TGATAATTGTGTAGTAATGTT-3' | (SEQ ID NO: 7463) |
| KRAS-4667 Target: | 5'-TAATTGTGTAGTAATGTTTTT-3' | (SEQ ID NO: 7464) |
| KRAS-4669 Target: | 5'-ATTGTGTAGTAATGTTTTTA-3' | (SEQ ID NO: 7465) |
| KRAS-4670 Target: | 5'-TTGTGTAGTAATGTTTTTAG-3' | (SEQ ID NO: 7466) |

TABLE 7 -continued

| DsiRNA Target Sequences (21 mers) | |
|---|---|
| KRAS-4704 Target: 5'-CCTTAAAGCTGAATTTATATT-3' | (SEQ ID NO: 7467) |
| KRAS-4706 Target: 5'-TTAAAGCTGAATTTATATTTA-3' | (SEQ ID NO: 7468) |
| KRAS-4715 Target: 5'-AATTTATATTTAGTAACTTCT-3' | (SEQ ID NO: 7469) |
| KRAS-4716 Target: 5'-ATTTATATTTAGTAACTTCTG-3' | (SEQ ID NO: 7470) |
| KRAS-4717 Target: 5'-TTTATATTTAGTAACTTCTGT-3' | (SEQ ID NO: 7471) |
| KRAS-4722 Target: 5'-ATTTAGTAACTTCTGTGTTAA-3' | (SEQ ID NO: 7472) |
| KRAS-4773 Target: 5'-ACTGAATAGCTGTCATAAAAT-3' | (SEQ ID NO: 7473) |
| KRAS-4774 Target: 5'-CTGAATAGCTGTCATAAAATG-3' | (SEQ ID NO: 7474) |
| KRAS-4788 Target: 5'-TAAAATGAAACTTTCTTTCTA-3' | (SEQ ID NO: 7475) |
| KRAS-4789 Target: 5'-AAAATGAAACTTTCTTTCTAA-3' | (SEQ ID NO: 7476) |
| KRAS-4790 Target: 5'-AAATGAAACTTTCTTTCTAAA-3' | (SEQ ID NO: 7477) |
| KRAS-4792 Target: 5'-ATGAAACTTTCTTTCTAAAGA-3' | (SEQ ID NO: 7478) |
| KRAS-4796 Target: 5'-AACTTTCTTTCTAAAGAAGA-3' | (SEQ ID NO: 7479) |
| KRAS-4821 Target: 5'-CACATGAGTTCTTGAAGAATA-3' | (SEQ ID NO: 7480) |
| KRAS-4830 Target: 5'-TCTTGAAGAATAGTCATAACT-3' | (SEQ ID NO: 7481) |
| KRAS-4831 Target: 5'-CTTGAAGAATAGTCATAACTA-3' | (SEQ ID NO: 7482) |
| KRAS-4832 Target: 5'-TTGAAGAATAGTCATAACTAG-3' | (SEQ ID NO: 7483) |
| KRAS-4835 Target: 5'-AAGAATAGTCATAACTAGATT-3' | (SEQ ID NO: 7484) |
| KRAS-4836 Target: 5'-AGAATAGTCATAACTAGATTA-3' | (SEQ ID NO: 7485) |
| KRAS-4837 Target: 5'-GAATAGTCATAACTAGATTAA-3' | (SEQ ID NO: 7486) |
| KRAS-4838 Target: 5'-AATAGTCATAACTAGATTAAG-3' | (SEQ ID NO: 7487) |
| KRAS-4842 Target: 5'-GTCATAACTAGATTAAGATCT-3' | (SEQ ID NO: 7488) |
| KRAS-4848 Target: 5'-ACTAGATTAAGATCTGTGTTT-3' | (SEQ ID NO: 7489) |
| KRAS-4850 Target: 5'-TAGATTAAGATCTGTGTTTTA-3' | (SEQ ID NO: 7490) |
| KRAS-4851 Target: 5'-AGATTAAGATCTGTGTTTTAG-3' | (SEQ ID NO: 7491) |
| KRAS-4853 Target: 5'-ATTAAGATCTGTGTTTTAGTT-3' | (SEQ ID NO: 7492) |
| KRAS-4860 Target: 5'-TCTGTGTTTTAGTTTAATAGT-3' | (SEQ ID NO: 7493) |
| KRAS-4861 Target: 5'-CTGTGTTTTAGTTTAATAGTT-3' | (SEQ ID NO: 7494) |
| KRAS-4863 Target: 5'-GTGTTTTAGTTTAATAGTTTG-3' | (SEQ ID NO: 7495) |
| KRAS-4865 Target: 5'-GTTTTAGTTTAATAGTTTGAA-3' | (SEQ ID NO: 7496) |
| KRAS-4866 Target: 5'-TTTTAGTTTAATAGTTTGAAG-3' | (SEQ ID NO: 7497) |
| KRAS-4892 Target: 5'-GTTTGGGATAATGATAGGTAA-3' | (SEQ ID NO: 7498) |
| KRAS-4894 Target: 5'-TTGGGATAATGATAGGTAATT-3' | (SEQ ID NO: 7499) |
| KRAS-4897 Target: 5'-GGATAATGATAGGTAATTTAG-3' | (SEQ ID NO: 7500) |
| KRAS-4898 Target: 5'-GATAATGATAGGTAATTTAGA-3' | (SEQ ID NO: 7501) |
| KRAS-4901 Target: 5'-AATGATAGGTAATTTAGATGA-3' | (SEQ ID NO: 7502) |
| KRAS-4902 Target: 5'-ATGATAGGTAATTTAGATGAA-3' | (SEQ ID NO: 7503) |
| KRAS-4907 Target: 5'-AGGTAATTTAGATGAATTTAG-3' | (SEQ ID NO: 7504) |
| KRAS-4909 Target: 5'-GTAATTTAGATGAATTTAGGG-3' | (SEQ ID NO: 7505) |

TABLE 7 -continued

| DsiRNA Target Sequences (21 mers) | | |
|---|---|---|
| KRAS-4916 Target: | 5'-AGATGAATTTAGGGGAAAAAA-3' | (SEQ ID NO: 7506) |
| KRAS-4917 Target: | 5'-GATGAATTTAGGGGAAAAAAA-3' | (SEQ ID NO: 7507) |
| KRAS-4928 Target: | 5'-GGGAAAAAAAAGTTATCTGCA-3' | (SEQ ID NO: 7508) |
| KRAS-4929 Target: | 5'-GGAAAAAAAAGTTATCTGCAG-3' | (SEQ ID NO: 7509) |
| KRAS-4934 Target: | 5'-AAAAAGTTATCTGCAGATATG-3' | (SEQ ID NO: 7510) |
| KRAS-5035 Target: | 5'-GTCTTGTGTTTTCATGTTGAA-3' | (SEQ ID NO: 7511) |
| KRAS-5036 Target: | 5'-TCTTGTGTTTTCATGTTGAAA-3' | (SEQ ID NO: 7512) |
| KRAS-5037 Target: | 5'-CTTGTGTTTTCATGTTGAAAA-3' | (SEQ ID NO: 7513) |
| KRAS-5047 Target: | 5'-CATGTTGAAAATACTTTTGCA-3' | (SEQ ID NO: 7514) |
| KRAS-5048 Target: | 5'-ATGTTGAAAATACTTTTGCAT-3' | (SEQ ID NO: 7515) |
| KRAS-5049 Target: | 5'-TGTTGAAAATACTTTTGCATT-3' | (SEQ ID NO: 7516) |
| KRAS-5050 Target: | 5'-GTTGAAAATACTTTTGCATTT-3' | (SEQ ID NO: 7517) |
| KRAS-5060 Target: | 5'-CTTTTGCATTTTTCCTTTGAG-3' | (SEQ ID NO: 7518) |
| KRAS-5077 Target: | 5'-TGAGTGCCAATTTCTTACTAG-3' | (SEQ ID NO: 7519) |
| KRAS-5082 Target: | 5'-GCCAATTTCTTACTAGTACTA-3' | (SEQ ID NO: 7520) |
| KRAS-5083 Target: | 5'-CCAATTTCTTACTAGTACTAT-3' | (SEQ ID NO: 7521) |
| KRAS-5092 Target: | 5'-TACTAGTACTATTTCTTAATG-3' | (SEQ ID NO: 7522) |
| KRAS-5093 Target: | 5'-ACTAGTACTATTTCTTAATGT-3' | (SEQ ID NO: 7523) |
| KRAS-5098 Target: | 5'-TACTATTTCTTAATGTAACAT-3' | (SEQ ID NO: 7524) |
| KRAS-5099 Target: | 5'-ACTATTTCTTAATGTAACATG-3' | (SEQ ID NO: 7525) |
| KRAS-5100 Target: | 5'-CTATTTCTTAATGTAACATGT-3' | (SEQ ID NO: 7526) |
| KRAS-5107 Target: | 5'-TTAATGTAACATGTTACCTG-3' | (SEQ ID NO: 7527) |
| KRAS-5124 Target: | 5'-CCTGGAATGTATTTTAACTAT-3' | (SEQ ID NO: 7528) |
| KRAS-5126 Target: | 5'-TGGAATGTATTTTAACTATTT-3' | (SEQ ID NO: 7529) |
| KRAS-5127 Target: | 5'-GGAATGTATTTTAACTATTTT-3' | (SEQ ID NO: 7530) |
| KRAS-5128 Target: | 5'-GAATGTATTTTAACTATTTTT-3' | (SEQ ID NO: 7531) |
| KRAS-5129 Target: | 5'-AATGTATTTTAACTATTTTTG-3' | (SEQ ID NO: 7532) |
| KRAS-5131 Target: | 5'-TGTATTTTAACTATTTTTGTA-3' | (SEQ ID NO: 7533) |
| KRAS-5133 Target: | 5'-TATTTTAACTATTTTTGTATA-3' | (SEQ ID NO: 7534) |
| KRAS-5134 Target: | 5'-ATTTTAACTATTTTTGTATAG-3' | (SEQ ID NO: 7535) |
| KRAS-5135 Target: | 5'-TTTTAACTATTTTTGTATAGT-3' | (SEQ ID NO: 7536) |
| KRAS-5142 Target: | 5'-TATTTTTGTATAGTGTAAACT-3' | (SEQ ID NO: 7537) |
| KRAS-5143 Target: | 5'-ATTTTTGTATAGTGTAAACTG-3' | (SEQ ID NO: 7538) |
| KRAS-5144 Target: | 5'-TTTTTGTATAGTGTAAACTGA-3' | (SEQ ID NO: 7539) |
| KRAS-5159 Target: | 5'-AACTGAAACATGCACATTTTG-3' | (SEQ ID NO: 7540) |
| KRAS-5165 Target: | 5'-AACATGCACATTTTGTACATT-3' | (SEQ ID NO: 7541) |
| KRAS-5218 Target: | 5'-TCCAGTTGTTTTCCATCATTT-3' | (SEQ ID NO: 7542) |
| KRAS-5220 Target: | 5'-CAGTTGTTTTCCATCATTTGG-3' | (SEQ ID NO: 7543) |
| KRAS-5257 Target: | 5'-ATGTTGGTCATATCAAACATT-3' | (SEQ ID NO: 7544) |

TABLE 7 -continued

DsiRNA Target Sequences (21 mers)

| | | |
|---|---|---|
| KRAS-5258 Target: | 5'-TGTTGGTCATATCAAACATTA-3' | (SEQ ID NO: 7545) |
| KRAS-5259 Target: | 5'-GTTGGTCATATCAAACATTAA-3' | (SEQ ID NO: 7546) |
| KRAS-5263 Target: | 5'-GTCATATCAAACATTAAAAAT-3' | (SEQ ID NO: 7547) |
| KRAS-5279 Target: | 5'-AAAATGACCACTCTTTTAATT-3' | (SEQ ID NO: 7548) |
| KRAS-5280 Target: | 5'-AAATGACCACTCTTTTAATTG-3' | (SEQ ID NO: 7549) |
| KRAS-5289 Target: | 5'-CTCTTTTAATTGAAATTAACT-3' | (SEQ ID NO: 7550) |
| KRAS-5290 Target: | 5'-TCTTTTAATTGAAATTAACTT-3' | (SEQ ID NO: 7551) |
| KRAS-5292 Target: | 5'-TTTTAATTGAAATTAACTTTT-3' | (SEQ ID NO: 7552) |
| KRAS-5294 Target: | 5'-TTAATTGAAATTAACTTTTAA-3' | (SEQ ID NO: 7553) |
| KRAS-5295 Target: | 5'-TAATTGAAATTAACTTTTAAA-3' | (SEQ ID NO: 7554) |
| KRAS-5296 Target: | 5'-AATTGAAATTAACTTTTAAAT-3' | (SEQ ID NO: 7555) |
| KRAS-5297 Target: | 5'-ATTGAAATTAACTTTTAAATG-3' | (SEQ ID NO: 7556) |
| KRAS-5298 Target: | 5'-TTGAAATTAACTTTTAAATGT-3' | (SEQ ID NO: 7557) |
| KRAS-5299 Target: | 5'-TGAAATTAACTTTTAAATGTT-3' | (SEQ ID NO: 7558) |
| KRAS-5302 Target: | 5'-AATTAACTTTTAAATGTTTAT-3' | (SEQ ID NO: 7559) |
| KRAS-5306 Target: | 5'-AACTTTTAAATGTTTATAGGA-3' | (SEQ ID NO: 7560) |
| KRAS-5310 Target: | 5'-TTTAAATGTTTATAGGAGTAT-3' | (SEQ ID NO: 7561) |
| KRAS-5311 Target: | 5'-TTAAATGTTTATAGGAGTATG-3' | (SEQ ID NO: 7562) |
| KRAS-5333 Target: | 5'-GCTGTGAAGTGATCTAAAATT-3' | (SEQ ID NO: 7563) |
| KRAS-5335 Target: | 5'-TGTGAAGTGATCTAAAATTTG-3' | (SEQ ID NO: 7564) |
| KRAS-5336 Target: | 5'-GTGAAGTGATCTAAAATTTGT-3' | (SEQ ID NO: 7565) |
| KRAS-5337 Target: | 5'-TGAAGTGATCTAAAATTTGTA-3' | (SEQ ID NO: 7566) |
| KRAS-5338 Target: | 5'-GAAGTGATCTAAAATTTGTAA-3' | (SEQ ID NO: 7567) |
| KRAS-5339 Target: | 5'-AAGTGATCTAAAATTTGTAAT-3' | (SEQ ID NO: 7568) |
| KRAS-5340 Target: | 5'-AGTGATCTAAAATTTGTAATA-3' | (SEQ ID NO: 7569) |
| KRAS-5344 Target: | 5'-ATCTAAAATTTGTAATATTTT-3' | (SEQ ID NO: 7570) |
| KRAS-5345 Target: | 5'-TCTAAAATTTGTAATATTTTT-3' | (SEQ ID NO: 7571) |
| KRAS-5349 Target: | 5'-AAATTTGTAATATTTTGTCA-3' | (SEQ ID NO: 7572) |
| KRAS-5350 Target: | 5'-AATTTGTAATATTTTGTCAT-3' | (SEQ ID NO: 7573) |
| KRAS-5351 Target: | 5'-ATTTGTAATATTTTGTCATG-3' | (SEQ ID NO: 7574) |
| KRAS-5355 Target: | 5'-GTAATATTTTGTCATGAACT-3' | (SEQ ID NO: 7575) |
| KRAS-5356 Target: | 5'-TAATATTTTGTCATGAACTG-3' | (SEQ ID NO: 7576) |
| KRAS-5372 Target: | 5'-AACTGTACTACTCCTAATTAT-3' | (SEQ ID NO: 7577) |
| KRAS-5373 Target: | 5'-ACTGTACTACTCCTAATTATT-3' | (SEQ ID NO: 7578) |
| KRAS-5383 Target: | 5'-TCCTAATTATTGTAATGTAAT-3' | (SEQ ID NO: 7579) |
| KRAS-5384 Target: | 5'-CCTAATTATTGTAATGTAATA-3' | (SEQ ID NO: 7580) |
| KRAS-5386 Target: | 5'-TAATTATTGTAATGTAATAAA-3' | (SEQ ID NO: 7581) |
| KRAS-5388 Target: | 5'-ATTATTGTAATGTAATAAAAA-3' | (SEQ ID NO: 7582) |
| KRAS-5389 Target: | 5'-TTATTGTAATGTAATAAAAAT-3' | (SEQ ID NO: 7583) |

TABLE 7 -continued

DsiRNA Target Sequences (21 mers)

| | | |
|---|---|---|
| KRAS-5391 Target: | 5'-ATTGTAATGTAATAAAAATAG-3' | (SEQ ID NO: 7584) |
| KRAS-5392 Target: | 5'-TTGTAATGTAATAAAAATAGT-3' | (SEQ ID NO: 7585) |
| KRAS-5396 Target: | 5'-AATGTAATAAAAATAGTTACA-3' | (SEQ ID NO: 7586) |
| KRAS-5397 Target: | 5'-ATGTAATAAAAATAGTTACAG-3' | (SEQ ID NO: 7587) |
| KRAS-5398 Target: | 5'-TGTAATAAAAATAGTTACAGT-3' | (SEQ ID NO: 7588) |
| KRAS-5406 Target: | 5'-AAATAGTTACAGTGACAAAAA-3' | (SEQ ID NO: 7589) |
| KRAS-5407 Target: | 5'-AATAGTTACAGTGACAAAAAA-3' | (SEQ ID NO: 7590) |
| KRAS-5409 Target: | 5'-TAGTTACAGTGACAAAAAAAA-3' | (SEQ ID NO: 7591) |
| KRAS-172  Target: | 5'-CCTGCTGAAAATGACTGAATA-3' | (SEQ ID NO: 7592) |
| KRAS-178  Target: | 5'-GAAAATGACTGAATATAAACT-3' | (SEQ ID NO: 7593) |
| KRAS-182  Target: | 5'-ATGACTGAATATAAACTTGTG-3' | (SEQ ID NO: 7594) |
| KRAS-244  Target: | 5'-ACAGCTAATTCAGAATCATTT-3' | (SEQ ID NO: 7595) |
| KRAS-268  Target: | 5'-GGACGAATATGATCCAACAAT-3' | (SEQ ID NO: 7596) |
| KRAS-304  Target: | 5'-GAAGCAAGTAGTAATTGATGG-3' | (SEQ ID NO: 7597) |
| KRAS-404  Target: | 5'-GGGGAGGGCTTTCTTTGTGTA-3' | (SEQ ID NO: 7598) |
| KRAS-413  Target: | 5'-TTTCTTTGTGTATTTGCCATA-3' | (SEQ ID NO: 7599) |
| KRAS-414  Target: | 5'-TTCTTTGTGTATTTGCCATAA-3' | (SEQ ID NO: 7600) |
| KRAS-415  Target: | 5'-TCTTTGTGTATTTGCCATAAA-3' | (SEQ ID NO: 7601) |
| KRAS-416  Target: | 5'-CTTTGTGTATTTGCCATAAAT-3' | (SEQ ID NO: 7602) |
| KRAS-420  Target: | 5'-GTGTATTTGCCATAAATAATA-3' | (SEQ ID NO: 7603) |
| KRAS-421  Target: | 5'-TGTATTTGCCATAAATAATAC-3' | (SEQ ID NO: 7604) |
| KRAS-427  Target: | 5'-TGCCATAAATAATACTAAATC-3' | (SEQ ID NO: 7605) |
| KRAS-428  Target: | 5'-GCCATAAATAATACTAAATCA-3' | (SEQ ID NO: 7606) |
| KRAS-430  Target: | 5'-CATAAATAATACTAAATCATT-3' | (SEQ ID NO: 7607) |
| KRAS-431  Target: | 5'-ATAAATAATACTAAATCATTT-3' | (SEQ ID NO: 7608) |
| KRAS-432  Target: | 5'-TAAATAATACTAAATCATTTG-3' | (SEQ ID NO: 7609) |
| KRAS-433  Target: | 5'-AAATAATACTAAATCATTTGA-3' | (SEQ ID NO: 7610) |
| KRAS-446  Target: | 5'-TCATTTGAAGATATTCACCAT-3' | (SEQ ID NO: 7611) |
| KRAS-448  Target: | 5'-ATTTGAAGATATTCACCATTA-3' | (SEQ ID NO: 7612) |
| KRAS-449  Target: | 5'-TTTGAAGATATTCACCATTAT-3' | (SEQ ID NO: 7613) |
| KRAS-450  Target: | 5'-TTGAAGATATTCACCATTATA-3' | (SEQ ID NO: 7614) |
| KRAS-451  Target: | 5'-TGAAGATATTCACCATTATAG-3' | (SEQ ID NO: 7615) |
| KRAS-461  Target: | 5'-CACCATTATAGAGAACAAATT-3' | (SEQ ID NO: 7616) |
| KRAS-463  Target: | 5'-CCATTATAGAGAACAAATTAA-3' | (SEQ ID NO: 7617) |
| KRAS-464  Target: | 5'-CATTATAGAGAACAAATTAAA-3' | (SEQ ID NO: 7618) |
| KRAS-465  Target: | 5'-ATTATAGAGAACAAATTAAAA-3' | (SEQ ID NO: 7619) |
| KRAS-466  Target: | 5'-TTATAGAGAACAAATTAAAAG-3' | (SEQ ID NO: 7620) |
| KRAS-516  Target: | 5'-TCCTAGTAGGAAATAAATGTG-3' | (SEQ ID NO: 7621) |
| KRAS-517  Target: | 5'-CCTAGTAGGAAATAAATGTGA-3' | (SEQ ID NO: 7622) |

TABLE 7 -continued

| | DsiRNA Target Sequences (21 mers) | |
|---|---|---|
| KRAS-581 | Target: 5'-GCAAGAAGTTATGGAATTCCT-3' | (SEQ ID NO: 7623) |
| KRAS-584 | Target: 5'-AGAAGTTATGGAATTCCTTTT-3' | (SEQ ID NO: 7624) |
| KRAS-585 | Target: 5'-GAAGTTATGGAATTCCTTTTA-3' | (SEQ ID NO: 7625) |
| KRAS-586 | Target: 5'-AAGTTATGGAATTCCTTTTAT-3' | (SEQ ID NO: 7626) |
| KRAS-587 | Target: 5'-AGTTATGGAATTCCTTTTATT-3' | (SEQ ID NO: 7627) |
| KRAS-634 | Target: 5'-AGTGGAGGATGCTTTTTATAC-3' | (SEQ ID NO: 7628) |
| KRAS-636 | Target: 5'-TGGAGGATGCTTTTTATACAT-3' | (SEQ ID NO: 7629) |
| KRAS-676 | Target: 5'-ATACAGATTGAAAAAAATCAG-3' | (SEQ ID NO: 7630) |
| KRAS-677 | Target: 5'-TACAGATTGAAAAAAATCAGC-3' | (SEQ ID NO: 7631) |
| KRAS-679 | Target: 5'-CAGATTGAAAAAAATCAGCAA-3' | (SEQ ID NO: 7632) |
| KRAS-680 | Target: 5'-AGATTGAAAAAAATCAGCAAA-3' | (SEQ ID NO: 7633) |
| KRAS-681 | Target: 5'-GATTGAAAAAAATCAGCAAAG-3' | (SEQ ID NO: 7634) |
| KRAS-682 | Target: 5'-ATTGAAAAAAATCAGCAAAGA-3' | (SEQ ID NO: 7635) |
| KRAS-710 | Target: 5'-ACTCCTGGCTGTGTGAAAATT-3' | (SEQ ID NO: 7636) |
| KRAS-714 | Target: 5'-CTGGCTGTGTGAAAATTAAAA-3' | (SEQ ID NO: 7637) |
| KRAS-718 | Target: 5'-CTGTGTGAAAATTAAAAAATG-3' | (SEQ ID NO: 7638) |
| KRAS-719 | Target: 5'-TGTGTGAAAATTAAAAAATGC-3' | (SEQ ID NO: 7639) |
| KRAS-720 | Target: 5'-GTGTGAAAATTAAAAAATGCA-3' | (SEQ ID NO: 7640) |
| KRAS-721 | Target: 5'-TGTGAAAATTAAAAAATGCAT-3' | (SEQ ID NO: 7641) |
| KRAS-723 | Target: 5'-TGAAAATTAAAAAATGCATTA-3' | (SEQ ID NO: 7642) |
| KRAS-724 | Target: 5'-GAAAATTAAAAAATGCATTAT-3' | (SEQ ID NO: 7643) |
| KRAS-725 | Target: 5'-AAAATTAAAAAATGCATTATA-3' | (SEQ ID NO: 7644) |
| KRAS-726 | Target: 5'-AAATTAAAAAATGCATTATAA-3' | (SEQ ID NO: 7645) |
| KRAS-728 | Target: 5'-ATTAAAAAATGCATTATAATG-3' | (SEQ ID NO: 7646) |
| KRAS-735 | Target: 5'-AATGCATTATAATGTAATCTG-3' | (SEQ ID NO: 7647) |
| KRAS-782 | Target: 5'-AGTTCGAGAAATTCGAAAACA-3' | (SEQ ID NO: 7648) |
| KRAS-783 | Target: 5'-GTTCGAGAAATTCGAAAACAT-3' | (SEQ ID NO: 7649) |
| KRAS-784 | Target: 5'-TTCGAGAAATTCGAAAACATA-3' | (SEQ ID NO: 7650) |
| KRAS-787 | Target: 5'-GAGAAATTCGAAAACATAAAG-3' | (SEQ ID NO: 7651) |
| KRAS-792 | Target: 5'-ATTCGAAAACATAAAGAAAAG-3' | (SEQ ID NO: 7652) |
| KRAS-793 | Target: 5'-TTCGAAAACATAAAGAAAAGA-3' | (SEQ ID NO: 7653) |
| KRAS-817 | Target: 5'-GCAAAGATGGTAAAAAGAAGA-3' | (SEQ ID NO: 7654) |
| KRAS-818 | Target: 5'-CAAAGATGGTAAAAAGAAGAA-3' | (SEQ ID NO: 7655) |
| KRAS-820 | Target: 5'-AAGATGGTAAAAAGAAGAAAA-3' | (SEQ ID NO: 7656) |
| KRAS-821 | Target: 5'-AGATGGTAAAAAGAAGAAAAA-3' | (SEQ ID NO: 7657) |
| KRAS-826 | Target: 5'-GTAAAAAGAAGAAAAAGAAGT-3' | (SEQ ID NO: 7658) |
| KRAS-827 | Target: 5'-TAAAAAGAAGAAAAAGAAGTC-3' | (SEQ ID NO: 7659) |
| KRAS-828 | Target: 5'-AAAAAGAAGAAAAAGAAGTCA-3' | (SEQ ID NO: 7660) |
| KRAS-844 | Target: 5'-AGTCAAAGACAAAGTGTGTAA-3' | (SEQ ID NO: 7661) |

TABLE 7 -continued

DsiRNA Target Sequences (21 mers)

| | | | |
|---|---|---|---|
| KRAS-845 | Target: | 5'-GTCAAAGACAAAGTGTGTAAT-3' | (SEQ ID NO: 7662) |
| KRAS-849 | Target: | 5'-AAGACAAAGTGTGTAATTATG-3' | (SEQ ID NO: 7663) |
| KRAS-851 | Target: | 5'-GACAAAGTGTGTAATTATGTA-3' | (SEQ ID NO: 7664) |
| KRAS-855 | Target: | 5'-AAGTGTGTAATTATGTAAATA-3' | (SEQ ID NO: 7665) |
| KRAS-857 | Target: | 5'-GTGTGTAATTATGTAAATACA-3' | (SEQ ID NO: 7666) |
| KRAS-859 | Target: | 5'-GTGTAATTATGTAAATACAAT-3' | (SEQ ID NO: 7667) |
| KRAS-860 | Target: | 5'-TGTAATTATGTAAATACAATT-3' | (SEQ ID NO: 7668) |
| KRAS-864 | Target: | 5'-ATTATGTAAATACAATTTGTA-3' | (SEQ ID NO: 7669) |
| KRAS-865 | Target: | 5'-TTATGTAAATACAATTTGTAC-3' | (SEQ ID NO: 7670) |
| KRAS-866 | Target: | 5'-TATGTAAATACAATTTGTACT-3' | (SEQ ID NO: 7671) |
| KRAS-867 | Target: | 5'-ATGTAAATACAATTTGTACTT-3' | (SEQ ID NO: 7672) |
| KRAS-873 | Target: | 5'-ATACAATTTGTACTTTTTCT-3' | (SEQ ID NO: 7673) |
| KRAS-874 | Target: | 5'-TACAATTTGTACTTTTTCTT-3' | (SEQ ID NO: 7674) |
| KRAS-899 | Target: | 5'-CATACTAGTACAAGTGGTAAT-3' | (SEQ ID NO: 7675) |
| KRAS-900 | Target: | 5'-ATACTAGTACAAGTGGTAATT-3' | (SEQ ID NO: 7676) |
| KRAS-906 | Target: | 5'-GTACAAGTGGTAATTTTTGTA-3' | (SEQ ID NO: 7677) |
| KRAS-907 | Target: | 5'-TACAAGTGGTAATTTTTGTAC-3' | (SEQ ID NO: 7678) |
| KRAS-914 | Target: | 5'-GGTAATTTTTGTACATTACAC-3' | (SEQ ID NO: 7679) |
| KRAS-915 | Target: | 5'-GTAATTTTTGTACATTACACT-3' | (SEQ ID NO: 7680) |
| KRAS-916 | Target: | 5'-TAATTTTTGTACATTACACTA-3' | (SEQ ID NO: 7681) |
| KRAS-917 | Target: | 5'-AATTTTTGTACATTACACTAA-3' | (SEQ ID NO: 7682) |
| KRAS-918 | Target: | 5'-ATTTTTGTACATTACACTAAA-3' | (SEQ ID NO: 7683) |
| KRAS-930 | Target: | 5'-TACACTAAATTATTAGCATTT-3' | (SEQ ID NO: 7684) |
| KRAS-932 | Target: | 5'-CACTAAATTATTAGCATTTGT-3' | (SEQ ID NO: 7685) |
| KRAS-933 | Target: | 5'-ACTAAATTATTAGCATTTGTT-3' | (SEQ ID NO: 7686) |
| KRAS-938 | Target: | 5'-ATTATTAGCATTTGTTTTAGC-3' | (SEQ ID NO: 7687) |
| KRAS-944 | Target: | 5'-AGCATTTGTTTTAGCATTACC-3' | (SEQ ID NO: 7688) |
| KRAS-945 | Target: | 5'-GCATTTGTTTTAGCATTACCT-3' | (SEQ ID NO: 7689) |
| KRAS-947 | Target: | 5'-ATTTGTTTTAGCATTACCTAA-3' | (SEQ ID NO: 7690) |
| KRAS-948 | Target: | 5'-TTTGTTTTAGCATTACCTAAT-3' | (SEQ ID NO: 7691) |
| KRAS-949 | Target: | 5'-TTGTTTTAGCATTACCTAATT-3' | (SEQ ID NO: 7692) |
| KRAS-950 | Target: | 5'-TGTTTTAGCATTACCTAATTT-3' | (SEQ ID NO: 7693) |
| KRAS-986 | Target: | 5'-CAGACTGTTAGCTTTTACCTT-3' | (SEQ ID NO: 7694) |
| KRAS-987 | Target: | 5'-AGACTGTTAGCTTTTACCTTA-3' | (SEQ ID NO: 7695) |
| KRAS-993 | Target: | 5'-TTAGCTTTTACCTTAAATGCT-3' | (SEQ ID NO: 7696) |
| KRAS-994 | Target: | 5'-TAGCTTTTACCTTAAATGCTT-3' | (SEQ ID NO: 7697) |
| KRAS-995 | Target: | 5'-AGCTTTTACCTTAAATGCTTA-3' | (SEQ ID NO: 7698) |
| KRAS-1001 | Target: | 5'-TACCTTAAATGCTTATTTTAA-3' | (SEQ ID NO: 7699) |
| KRAS-1002 | Target: | 5'-ACCTTAAATGCTTATTTTAAA-3' | (SEQ ID NO: 7700) |

TABLE 7 -continued

DsiRNA Target Sequences (21 mers)

| | | |
|---|---|---|
| KRAS-1008 Target: | 5'-AATGCTTATTTTAAAATGACA-3' | (SEQ ID NO: 7701) |
| KRAS-1010 Target: | 5'-TGCTTATTTTAAAATGACAGT-3' | (SEQ ID NO: 7702) |
| KRAS-1027 Target: | 5'-CAGTGGAAGTTTTTTTTCCT-3' | (SEQ ID NO: 7703) |
| KRAS-1029 Target: | 5'-GTGGAAGTTTTTTTTCCTCT-3' | (SEQ ID NO: 7704) |
| KRAS-1030 Target: | 5'-TGGAAGTTTTTTTTCCTCTA-3' | (SEQ ID NO: 7705) |
| KRAS-1068 Target: | 5'-AGTTTTGGTTTTTGAACTAGC-3' | (SEQ ID NO: 7706) |
| KRAS-1090 Target: | 5'-ATGCCTGTGAAAAAGAAACTG-3' | (SEQ ID NO: 7707) |
| KRAS-1097 Target: | 5'-TGAAAAAGAAACTGAATACCT-3' | (SEQ ID NO: 7708) |
| KRAS-1098 Target: | 5'-GAAAAAGAAACTGAATACCTA-3' | (SEQ ID NO: 7709) |
| KRAS-1104 Target: | 5'-GAAACTGAATACCTAAGATTT-3' | (SEQ ID NO: 7710) |
| KRAS-1145 Target: | 5'-CATGCAGTTGATTACTTCTTA-3' | (SEQ ID NO: 7711) |
| KRAS-1146 Target: | 5'-ATGCAGTTGATTACTTCTTAT-3' | (SEQ ID NO: 7712) |
| KRAS-1150 Target: | 5'-AGTTGATTACTTCTTATTTTT-3' | (SEQ ID NO: 7713) |
| KRAS-1158 Target: | 5'-ACTTCTTATTTTCTTACCAA-3' | (SEQ ID NO: 7714) |
| KRAS-1159 Target: | 5'-CTTCTTATTTTTCTTACCAAT-3' | (SEQ ID NO: 7715) |
| KRAS-1160 Target: | 5'-TTCTTATTTTCTTACCAATT-3' | (SEQ ID NO: 7716) |
| KRAS-1183 Target: | 5'-GAATGTTGGTGTGAAACAAAT-3' | (SEQ ID NO: 7717) |
| KRAS-1186 Target: | 5'-TGTTGGTGTGAAACAAATTAA-3' | (SEQ ID NO: 7718) |
| KRAS-1187 Target: | 5'-GTTGGTGTGAAACAAATTAAT-3' | (SEQ ID NO: 7719) |
| KRAS-1195 Target: | 5'-GAAACAAATTAATGAAGCTTT-3' | (SEQ ID NO: 7720) |
| KRAS-1196 Target: | 5'-AAACAAATTAATGAAGCTTTT-3' | (SEQ ID NO: 7721) |
| KRAS-1228 Target: | 5'-ATTCTGTGTTTATCTAGTCA-3' | (SEQ ID NO: 7722) |
| KRAS-1229 Target: | 5'-TTCTGTGTTTTATCTAGTCAC-3' | (SEQ ID NO: 7723) |
| KRAS-1232 Target: | 5'-TGTGTTTTATCTAGTCACATA-3' | (SEQ ID NO: 7724) |
| KRAS-1233 Target: | 5'-GTGTTTTATCTAGTCACATAA-3' | (SEQ ID NO: 7725) |
| KRAS-1238 Target: | 5'-TTATCTAGTCACATAAATGGA-3' | (SEQ ID NO: 7726) |
| KRAS-1239 Target: | 5'-TATCTAGTCACATAAATGGAT-3' | (SEQ ID NO: 7727) |
| KRAS-1247 Target: | 5'-CACATAAATGGATTAATTACT-3' | (SEQ ID NO: 7728) |
| KRAS-1248 Target: | 5'-ACATAAATGGATTAATTACTA-3' | (SEQ ID NO: 7729) |
| KRAS-1253 Target: | 5'-AATGGATTAATTACTAATTTC-3' | (SEQ ID NO: 7730) |
| KRAS-1255 Target: | 5'-TGGATTAATTACTAATTTCAG-3' | (SEQ ID NO: 7731) |
| KRAS-1256 Target: | 5'-GGATTAATTACTAATTTCAGT-3' | (SEQ ID NO: 7732) |
| KRAS-1257 Target: | 5'-GATTAATTACTAATTTCAGTT-3' | (SEQ ID NO: 7733) |
| KRAS-1285 Target: | 5'-TCTAATTGGTTTTTACTGAAA-3' | (SEQ ID NO: 7734) |
| KRAS-1289 Target: | 5'-ATTGGTTTTTACTGAAACATT-3' | (SEQ ID NO: 7735) |
| KRAS-1290 Target: | 5'-TTGGTTTTTACTGAAACATTG-3' | (SEQ ID NO: 7736) |
| KRAS-1305 Target: | 5'-ACATTGAGGGAACACAAATTT-3' | (SEQ ID NO: 7737) |
| KRAS-1306 Target: | 5'-CATTGAGGGAACACAAATTTA-3' | (SEQ ID NO: 7738) |
| KRAS-1379 Target: | 5'-CCTGATGAATGTAAAGTTACA-3' | (SEQ ID NO: 7739) |

TABLE 7 -continued

| DsiRNA Target Sequences (21 mers) | |
|---|---|
| KRAS-1380 Target: 5'-CTGATGAATGTAAAGTTACAC-3' | (SEQ ID NO: 7740) |
| KRAS-1452 Target: 5'-CCCCAAAATATTATATTTTTT-3' | (SEQ ID NO: 7741) |
| KRAS-1453 Target: 5'-CCCAAAATATTATATTTTTTC-3' | (SEQ ID NO: 7742) |
| KRAS-1454 Target: 5'-CCAAAATATTATATTTTTCT-3' | (SEQ ID NO: 7743) |
| KRAS-1455 Target: 5'-CAAAATATTATATTTTTCTA-3' | (SEQ ID NO: 7744) |
| KRAS-1457 Target: 5'-AAATATTATATTTTTCTATA-3' | (SEQ ID NO: 7745) |
| KRAS-1458 Target: 5'-AATATTATATTTTTCTATAA-3' | (SEQ ID NO: 7746) |
| KRAS-1459 Target: 5'-ATATTATATTTTTCTATAAA-3' | (SEQ ID NO: 7747) |
| KRAS-1460 Target: 5'-TATTATATTTTTCTATAAAA-3' | (SEQ ID NO: 7748) |
| KRAS-1461 Target: 5'-ATTATATTTTTCTATAAAAA-3' | (SEQ ID NO: 7749) |
| KRAS-1462 Target: 5'-TTATATTTTTCTATAAAAAG-3' | (SEQ ID NO: 7750) |
| KRAS-1463 Target: 5'-TATATTTTTCTATAAAAAGA-3' | (SEQ ID NO: 7751) |
| KRAS-1464 Target: 5'-ATATTTTTCTATAAAAAGAA-3' | (SEQ ID NO: 7752) |
| KRAS-1469 Target: 5'-TTTTCTATAAAAGAAAAAAA-3' | (SEQ ID NO: 7753) |
| KRAS-1470 Target: 5'-TTTCTATAAAAGAAAAAAAT-3' | (SEQ ID NO: 7754) |
| KRAS-1472 Target: 5'-TCTATAAAAGAAAAAAATGG-3' | (SEQ ID NO: 7755) |
| KRAS-1473 Target: 5'-CTATAAAAGAAAAAAATGGA-3' | (SEQ ID NO: 7756) |
| KRAS-1474 Target: 5'-TATAAAAGAAAAAAATGGAA-3' | (SEQ ID NO: 7757) |
| KRAS-1475 Target: 5'-ATAAAAGAAAAAAATGGAAA-3' | (SEQ ID NO: 7758) |
| KRAS-1476 Target: 5'-TAAAAGAAAAAAATGGAAAA-3' | (SEQ ID NO: 7759) |
| KRAS-1477 Target: 5'-AAAAGAAAAAAATGGAAAAA-3' | (SEQ ID NO: 7760) |
| KRAS-1478 Target: 5'-AAAGAAAAAAATGGAAAAAA-3' | (SEQ ID NO: 7761) |
| KRAS-1482 Target: 5'-GAAAAAATGGAAAAAAATTA-3' | (SEQ ID NO: 7762) |
| KRAS-1483 Target: 5'-AAAAAATGGAAAAAAATTAC-3' | (SEQ ID NO: 7763) |
| KRAS-1488 Target: 5'-AATGGAAAAAATTACAAGGC-3' | (SEQ ID NO: 7764) |
| KRAS-1489 Target: 5'-ATGGAAAAAATTACAAGGCA-3' | (SEQ ID NO: 7765) |
| KRAS-1490 Target: 5'-TGGAAAAAATTACAAGGCAA-3' | (SEQ ID NO: 7766) |
| KRAS-1525 Target: 5'-AGGCCATTTCCTTTTCACATT-3' | (SEQ ID NO: 7767) |
| KRAS-1531 Target: 5'-TTTCCTTTTCACATTAGATAA-3' | (SEQ ID NO: 7768) |
| KRAS-1538 Target: 5'-TTCACATTAGATAAATTACTA-3' | (SEQ ID NO: 7769) |
| KRAS-1539 Target: 5'-TCACATTAGATAAATTACTAT-3' | (SEQ ID NO: 7770) |
| KRAS-1540 Target: 5'-CACATTAGATAAATTACTATA-3' | (SEQ ID NO: 7771) |
| KRAS-1595 Target: 5'-CCAGTATGAAATGGGGATTAT-3' | (SEQ ID NO: 7772) |
| KRAS-1604 Target: 5'-AATGGGGATTATTATAGCAAC-3' | (SEQ ID NO: 7773) |
| KRAS-1631 Target: 5'-GGGGCTATATTTACATGCTAC-3' | (SEQ ID NO: 7774) |
| KRAS-1632 Target: 5'-GGGCTATATTTACATGCTACT-3' | (SEQ ID NO: 7775) |
| KRAS-1633 Target: 5'-GGCTATATTTACATGCTACTA-3' | (SEQ ID NO: 7776) |
| KRAS-1634 Target: 5'-GCTATATTTACATGCTACTAA-3' | (SEQ ID NO: 7777) |
| KRAS-1635 Target: 5'-CTATATTTACATGCTACTAAA-3' | (SEQ ID NO: 7778) |

TABLE 7 -continued

| DsiRNA Target Sequences (21 mers) | |
|---|---|
| KRAS-1640 Target: 5'-TTTACATGCTACTAAATTTTT-3' | (SEQ ID NO: 7779) |
| KRAS-1647 Target: 5'-GCTACTAAATTTTTATAATAA-3' | (SEQ ID NO: 7780) |
| KRAS-1648 Target: 5'-CTACTAAATTTTTATAATAAT-3' | (SEQ ID NO: 7781) |
| KRAS-1650 Target: 5'-ACTAAATTTTTATAATAATTG-3' | (SEQ ID NO: 7782) |
| KRAS-1651 Target: 5'-CTAAATTTTTATAATAATTGA-3' | (SEQ ID NO: 7783) |
| KRAS-1652 Target: 5'-TAAATTTTTATAATAATTGAA-3' | (SEQ ID NO: 7784) |
| KRAS-1653 Target: 5'-AAATTTTTATAATAATTGAAA-3' | (SEQ ID NO: .7785) |
| KRAS-1654 Target: 5'-AATTTTTATAATAATTGAAAA-3' | (SEQ ID NO: 7786) |
| KRAS-1655 Target: 5'-ATTTTTATAATAATTGAAAAG-3' | (SEQ ID NO: 7787) |
| KRAS-1656 Target: 5'-TTTTTATAATAATTGAAAAGA-3' | (SEQ ID NO: 7788) |
| KRAS-1657 Target: 5'-TTTTATAATAATTGAAAAGAT-3' | (SEQ ID NO: 7789) |
| KRAS-1658 Target: 5'-TTTATAATAATTGAAAAGATT-3' | (SEQ ID NO: 7790) |
| KRAS-1662 Target: 5'-TAATAATTGAAAAGATTTTAA-3' | (SEQ ID NO: 7791) |
| KRAS-1663 Target: 5'-AATAATTGAAAAGATTTTAAC-3' | (SEQ ID NO: 7792) |
| KRAS-1665 Target: 5'-TAATTGAAAAGATTTTAACAA-3' | (SEQ ID NO: 7793) |
| KRAS-1666 Target: 5'-AATTGAAAAGATTTTAACAAG-3' | (SEQ ID NO: 7794) |
| KRAS-1667 Target: 5'-ATTGAAAAGATTTTAACAAGT-3' | (SEQ ID NO: 7795) |
| KRAS-1668 Target: 5'-TTGAAAAGATTTTAACAAGTA-3' | (SEQ ID NO: 7796) |
| KRAS-1669 Target: 5'-TGAAAAGATTTTAACAAGTAT-3' | (SEQ ID NO: 7797) |
| KRAS-1670 Target: 5'-GAAAAGATTTTAACAAGTATA-3' | (SEQ ID NO: 7798) |
| KRAS-1671 Target: 5'-AAAAGATTTTAACAAGTATAA-3' | (SEQ ID NO: 7799) |
| KRAS-1672 Target: 5'-AAAGATTTTAACAAGTATAAA-3' | (SEQ ID NO: 7800) |
| KRAS-1673 Target: 5'-AAGATTTTAACAAGTATAAAA-3' | (SEQ ID NO: 7801) |
| KRAS-1680 Target: 5'-TAACAAGTATAAAAAATTCTC-3' | (SEQ ID NO: 7802) |
| KRAS-1681 Target: 5'-AACAAGTATAAAAAATTCTCA-3' | (SEQ ID NO: 7803) |
| KRAS-1682 Target: 5'-ACAAGTATAAAAAATTCTCAT-3' | (SEQ ID NO: 7804) |
| KRAS-1683 Target: 5'-CAAGTATAAAAAATTCTCATA-3' | (SEQ ID NO: 7805) |
| KRAS-1684 Target: 5'-AAGTATAAAAAATTCTCATAG-3' | (SEQ ID NO: 7806) |
| KRAS-1685 Target: 5'-AGTATAAAAAATTCTCATAGG-3' | (SEQ ID NO: 7807) |
| KRAS-1686 Target: 5GTATAAAAAATTCTCATAGGA-3' | (SEQ ID NO: 7808) |
| KRAS-1687 Target: 5'-TATAAAAAATTCTCATAGGAA-3' | (SEQ ID NO: 7809) |
| KRAS-1689 Target: 5'-TAAAAAATTCTCATAGGAATT-3' | (SEQ ID NO: 7810) |
| KRAS-1690 Target: 5'-AAAAAATTCTCATAGGAATTA-3' | (SEQ ID NO: 7811) |
| KRAS-1734 Target: 5'-TGCTCTTTCATAGTATAACTT-3' | (SEQ ID NO: 7812) |
| KRAS-1739 Target: 5'-TTTCATAGTATAACTTTAAAT-3' | (SEQ ID NO: 7813) |
| KRAS-1740 Target: 5'-TTCATAGTATAACTTTAAATC-3' | (SEQ ID NO: 7814) |
| KRAS-1751 Target: 5'-ACTTTAAATCTTTTCTTCAAC-3' | (SEQ ID NO: 7815) |
| KRAS-1752 Target: 5'-CTTTAAATCTTTTCTTCAACT-3' | (SEQ ID NO: 7816) |
| KRAS-1767 Target: 5'-TCAACTTGAGTCTTTGAAGAT-3' | (SEQ ID NO: 7817) |

TABLE 7 -continued

DsiRNA Target Sequences (21 mers)

| | | |
|---|---|---|
| KRAS-1769 Target: | 5'-AACTTGAGTCTTTGAAGATAG-3' | (SEQ ID NO: 7818) |
| KRAS-1770 Target: | 5'-ACTTGAGTCTTTGAAGATAGT-3' | (SEQ ID NO: 7819) |
| KRAS-1781 Target: | 5'-TGAAGATAGTTTTAATTCTGC-3' | (SEQ ID NO: 7820) |
| KRAS-1782 Target: | 5'-GAAGATAGTTTTAATTCTGCT-3' | (SEQ ID NO: 7821) |
| KRAS-1783 Target: | 5'-AAGATAGTTTTAATTCTGCTT-3' | (SEQ ID NO: 7822) |
| KRAS-1797 Target: | 5'-TCTGCTTGTGACATTAAAAGA-3' | (SEQ ID NO: 7823) |
| KRAS-2045 Target: | 5'-AGAGCATTGCTTTTGTTTCTT-3' | (SEQ ID NO: 7824) |
| KRAS-2046 Target: | 5'-GAGCATTGCTTTTGTTTCTTA-3' | (SEQ ID NO: 7825) |
| KRAS-2052 Target: | 5'-TGCTTTTGTTTCTTAAGAAAA-3' | (SEQ ID NO: 7826) |
| KRAS-2059 Target: | 5'-GTTTCTTAAGAAAACAAACTC-3' | (SEQ ID NO: 7827) |
| KRAS-2060 Target: | 5'-TTTCTTAAGAAAACAAACTCT-3' | (SEQ ID NO: 7828) |
| KRAS-2061 Target: | 5'-TTCTTAAGAAAACAAACTCTT-3' | (SEQ ID NO: 7829) |
| KRAS-2062 Target: | 5'-TCTTAAGAAAACAAACTCTTT-3' | (SEQ ID NO: 7830) |
| KRAS-2063 Target: | 5'-CTTAAGAAAACAAACTCTTTT-3' | (SEQ ID NO: 7831) |
| KRAS-2064 Target: | 5'-TTAAGAAAACAAACTCTTTTT-3' | (SEQ ID NO: 7832) |
| KRAS-2065 Target: | 5'-TAAGAAAACAAACTCTTTTTT-3' | (SEQ ID NO: 7833) |
| KRAS-2069 Target: | 5'-AAAACAAACTCTTTTTTAAAA-3' | (SEQ ID NO: 7834) |
| KRAS-2075 Target: | 5'-AACTCTTTTTTAAAAATTACT-3' | (SEQ ID NO: 7835) |
| KRAS-2076 Target: | 5'-ACTCTTTTTTAAAAATTACTT-3' | (SEQ ID NO: 7836) |
| KRAS-2077 Target: | 5'-CTCTTTTTTAAAAATTACTTT-3' | (SEQ ID NO: 7837) |
| KRAS-2078 Target: | 5'-TCTTTTTTAAAAATTACTTTT-3' | (SEQ ID NO: 7838) |
| KRAS-2079 Target: | 5'-CTTTTTTAAAAATTACTTTTA-3' | (SEQ ID NO: 7839) |
| KRAS-2080 Target: | 5'-TTTTTTAAAAATTACTTTTAA-3' | (SEQ ID NO: 7840) |
| KRAS-2081 Target: | 5'-TTTTTAAAAATTACTTTTAAA-3' | (SEQ ID NO: 7841) |
| KRAS-2082 Target: | 5'-TTTTAAAAATTACTTTTAAAT-3' | (SEQ ID NO: 7842) |
| KRAS-2083 Target: | 5'-TTTAAAAATTACTTTTAAATA-3' | (SEQ ID NO: 7843) |
| KRAS-2090 Target: | 5'-ATTACTTTTAAATATTAACTC-3' | (SEQ ID NO: 7844) |
| KRAS-2091 Target: | 5'-TTACTTTTAAATATTAACTCA-3' | (SEQ ID NO: 7845) |
| KRAS-2093 Target: | 5'-ACTTTTAAATATTAACTCAAA-3' | (SEQ ID NO: 7846) |
| KRAS-2095 Target: | 5'-TTTTAAATATTAACTCAAAAG-3' | (SEQ ID NO: 7847) |
| KRAS-2096 Target: | 5'-TTTAAATATTAACTCAAAAGT-3' | (SEQ ID NO: 7848) |
| KRAS-2097 Target: | 5'-TTAAATATTAACTCAAAAGTT-3' | (SEQ ID NO: 7849) |
| KRAS-2098 Target: | 5'-TAAATATTAACTCAAAAGTTG-3' | (SEQ ID NO: 7850) |
| KRAS-2132 Target: | 5'-GTGGTGTGCCAAGACATTAAT-3' | (SEQ ID NO: 7851) |
| KRAS-2137 Target: | 5'-GTGCCAAGACATTAATTTTTT-3' | (SEQ ID NO: 7852) |
| KRAS-2138 Target: | 5'-TGCCAAGACATTAATTTTTTT-3' | (SEQ ID NO: 7853) |
| KRAS-2144 Target: | 5'-GACATTAATTTTTTTTTAAA-3' | (SEQ ID NO: 7854) |
| KRAS-2145 Target: | 5'-ACATTAATTTTTTTTTAAAC-3' | (SEQ ID NO: 7855) |
| KRAS-2147 Target: | 5'-ATTAATTTTTTTTTAAACAA-3' | (SEQ ID NO: 7856) |

TABLE 7 -continued

DsiRNA Target Sequences (21 mers)

KRAS-2149 Target: 5'-TAATTTTTTTTTAAACAATG-3' (SEQ ID NO: 7857)

KRAS-2150 Target: 5'-AATTTTTTTTTAAACAATGA-3' (SEQ ID NO: 7858)

KRAS-2151 Target: 5'-ATTTTTTTTTAAACAATGAA-3' (SEQ ID NO: 7859)

KRAS-2152 Target: 5'-TTTTTTTTTAAACAATGAAG-3' (SEQ ID NO: 7860)

KRAS-2153 Target: 5'-TTTTTTTTAAACAATGAAGT-3' (SEQ ID NO: 7861)

KRAS-2155 Target: 5'-TTTTTTTAAACAATGAAGTGA-3' (SEQ ID NO: 7862)

KRAS-2156 Target: 5'-TTTTTTAAACAATGAAGTGAA-3' (SEQ ID NO: 7863)

KRAS-2157 Target: 5'-TTTTTAAACAATGAAGTGAAA-3' (SEQ ID NO: 7864)

KRAS-2165 Target: 5'-CAATGAAGTGAAAAGTTTTA-3' (SEQ ID NO: 7865)

KRAS-2171 Target: 5'-AGTGAAAAGTTTTACAATCT-3' (SEQ ID NO: 7866)

KRAS-2172 Target: 5'-GTGAAAAGTTTTACAATCTC-3' (SEQ ID NO: 7867)

KRAS-2173 Target: 5'-TGAAAAGTTTTACAATCTCT-3' (SEQ ID NO: 7868)

KRAS-2214 Target: 5'-ACACTGGTTAAATTAACATTG-3' (SEQ ID NO: 7869)

KRAS-2215 Target: 5'-CACTGGTTAAATTAACATTGC-3' (SEQ ID NO: 7870)

KRAS-2216 Target: 5'-ACTGGTTAAATTAACATTGCA-3' (SEQ ID NO: 7871)

KRAS-2227 Target: 5'-TAACATTGCATAAACACTTTT-3' (SEQ ID NO: 7872)

KRAS-2245 Target: 5'-TTTCAAGTCTGATCCATATTT-3' (SEQ ID NO: 7873)

KRAS-2255 Target: 5'-GATCCATATTTAATAATGCTT-3' (SEQ ID NO: 7874)

KRAS-2256 Target: 5'-ATCCATATTTAATAATGCTTT-3' (SEQ ID NO: 7875)

KRAS-2257 Target: 5'-TCCATATTTAATAATGCTTTA-3' (SEQ ID NO: 7876)

KRAS-2258 Target: 5'-CCATATTTAATAATGCTTTAA-3' (SEQ ID NO: 7877)

KRAS-2259 Target: 5'-CATATTTAATAATGCTTTAAA-3' (SEQ ID NO: 7878)

KRAS-2260 Target: 5'-ATATTTAATAATGCTTTAAAA-3' (SEQ ID NO: 7879)

KRAS-2262 Target: 5'-ATTTAATAATGCTTTAAAATA-3' (SEQ ID NO: 7880)

KRAS-2263 Target: 5'-TTTAATAATGCTTTAAAATAA-3' (SEQ ID NO: 7881)

KRAS-2264 Target: 5'-TTAATAATGCTTTAAAATAAA-3' (SEQ ID NO: 7882)

KRAS-2265 Target: 5'-TAATAATGCTTTAAAATAAAA-3' (SEQ ID NO: 7883)

KRAS-2272 Target: 5'-GCTTTAAAATAAAATAAAAA-3' (SEQ ID NO: 7884)

KRAS-2278 Target: 5'-AAATAAAAATAAAAACAATCC-3' (SEQ ID NO: 7885)

KRAS-2279 Target: 5'-AATAAAAATAAAAACAATCCT-3' (SEQ ID NO: 7886)

KRAS-2280 Target: 5'-ATAAAAATAAAAACAATCCTT-3' (SEQ ID NO: 7887)

KRAS-2281 Target: 5'-TAAAAATAAAAACAATCCTTT-3' (SEQ ID NO: 7888)

KRAS-2282 Target: 5'-AAAAATAAAAACAATCCTTTT-3' (SEQ ID NO: 7889)

KRAS-2283 Target: 5'-AAAATAAAAACAATCCTTTTG-3' (SEQ ID NO: 7890)

KRAS-2284 Target: 5'-AAATAAAAACAATCCTTTTGA-3' (SEQ ID NO: 7891)

KRAS-2285 Target: 5'-AATAAAAACAATCCTTTTGAT-3' (SEQ ID NO: 7892)

KRAS-2289 Target: 5'-AAAACAATCCTTTTGATAAAT-3' (SEQ ID NO: 7893)

KRAS-2294 Target: 5'-AATCCTTTTGATAAATTTAAA-3' (SEQ ID NO: 7894)

KRAS-2295 Target: 5'-ATCCTTTTGATAAATTTAAAA-3' (SEQ ID NO: 7895)

TABLE 7 -continued

| DsiRNA Target Sequences (21 mers) | | |
|---|---|---|
| KRAS-2296 Target: | 5'-TCCTTTTGATAAATTTAAAAT-3' | (SEQ ID NO: 7896) |
| KRAS-2300 Target: | 5'-TTTGATAAATTTAAAATGTTA-3' | (SEQ ID NO: 7897) |
| KRAS-2301 Target: | 5'-TTGATAAATTTAAAATGTTAC-3' | (SEQ ID NO: 7898) |
| KRAS-2302 Target: | 5'-TGATAAATTTAAAATGTTACT-3' | (SEQ ID NO: 7899) |
| KRAS-2303 Target: | 5'-GATAAATTTAAAATGTTACTT-3' | (SEQ ID NO: 7900) |
| KRAS-2304 Target: | 5'-ATAAATTTAAAATGTTACTTA-3' | (SEQ ID NO: 7901) |
| KRAS-2305 Target: | 5'-TAAATTTAAAATGTTACTTAT-3' | (SEQ ID NO: 7902) |
| KRAS-2307 Target: | 5'-AATTTAAAATGTTACTTATTT-3' | (SEQ ID NO: 7903) |
| KRAS-2308 Target: | 5'-ATTTAAAATGTTACTTATTTT-3' | (SEQ ID NO: 7904) |
| KRAS-2309 Target: | 5'-TTTAAAATGTTACTTATTTTA-3' | (SEQ ID NO: 7905) |
| KRAS-2310 Target: | 5'-TTAAAATGTTACTTATTTTAA-3' | (SEQ ID NO: 7906) |
| KRAS-2311 Target: | 5'-TAAAATGTTACTTATTTTAAA-3' | (SEQ ID NO: 7907) |
| KRAS-2313 Target: | 5'-AAATGTTACTTATTTTAAAAT-3' | (SEQ ID NO: 7908) |
| KRAS-2318 Target: | 5'-TTACTTATTTTAAAATAAATG-3' | (SEQ ID NO: 7909) |
| KRAS-2320 Target: | 5'-ACTTATTTTAAAATAAATGAA-3' | (SEQ ID NO: 7910) |
| KRAS-2321 Target: | 5'-CTTATTTTAAAATAAATGAAG-3' | (SEQ ID NO: 7911) |
| KRAS-2324 Target: | 5'-ATTTTAAAATAAATGAAGTGA-3' | (SEQ ID NO: 7912) |
| KRAS-2325 Target: | 5'-TTTTAAAATAAATGAAGTGAG-3' | (SEQ ID NO: 7913) |
| KRAS-2445 Target: | 5'-TATCCATTTCTTCATGTTAAA-3' | (SEQ ID NO: 7914) |
| KRAS-2446 Target: | 5'-ATCCATTTCTTCATGTTAAAA-3' | (SEQ ID NO: 7915) |
| KRAS-2473 Target: | 5'-ATCTCAAACTCTTAGTTTTTT-3' | (SEQ ID NO: 7916) |
| KRAS-2483 Target: | 5'-CTTAGTTTTTTTTTTACAA-3' | (SEQ ID NO: 7917) |
| KRAS-2484 Target: | 5'-TTAGTTTTTTTTTTTACAAC-3' | (SEQ ID NO: 7918) |
| KRAS-2485 Target: | 5'-TAGTTTTTTTTTTTACAACT-3' | (SEQ ID NO: 7919) |
| KRAS-2486 Target: | 5'-AGTTTTTTTTTTTACAACTA-3' | (SEQ ID NO: 7920) |
| KRAS-2487 Target: | 5'-GTTTTTTTTTTTACAACTAT-3' | (SEQ ID NO: 7921) |
| KRAS-2488 Target: | 5'-TTTTTTTTTTTACAACTATG-3' | (SEQ ID NO: 7922) |
| KRAS-2489 Target: | 5'-TTTTTTTTTTACAACTATGT-3' | (SEQ ID NO: 7923) |
| KRAS-2490 Target: | 5'-TTTTTTTTTACAACTATGTA-3' | (SEQ ID NO: 7924) |
| KRAS-2491 Target: | 5'-TTTTTTTTACAACTATGTAA-3' | (SEQ ID NO: 7925) |
| KRAS-2492 Target: | 5'-TTTTTTTACAACTATGTAAT-3' | (SEQ ID NO: 7926) |
| KRAS-2493 Target: | 5'-TTTTTTACAACTATGTAATT-3' | (SEQ ID NO: 7927) |
| KRAS-2500 Target: | 5'-ACAACTATGTAATTTATATTC-3' | (SEQ ID NO: 7928) |
| KRAS-2501 Target: | 5'-CAACTATGTAATTTATATTCC-3' | (SEQ ID NO: 7929) |
| KRAS-2502 Target: | 5'-AACTATGTAATTTATATTCCA-3' | (SEQ ID NO: 7930) |
| KRAS-2508 Target: | 5'-GTAATTTATATTCCATTTACA-3' | (SEQ ID NO: 7931) |
| KRAS-2509 Target: | 5'-TAATTTATATTCCATTTACAT-3' | (SEQ ID NO: 7932) |
| KRAS-2510 Target: | 5'-AATTTATATTCCATTTACATA-3' | (SEQ ID NO: 7933) |
| KRAS-2511 Target: | 5'-ATTTATATTCCATTTACATAA-3' | (SEQ ID NO: 7934) |

TABLE 7 -continued

| DsiRNA Target Sequences (21 mers) | | |
|---|---|---|
| KRAS-2523 Target: | 5'-TTTACATAAGGATACACTTAT-3' | (SEQ ID NO: 7935) |
| KRAS-2527 Target: | 5'-CATAAGGATACACTTATTTGT-3' | (SEQ ID NO: 7936) |
| KRAS-2559 Target: | 5'-CAATCTGTAAATTTTTAACCT-3' | (SEQ ID NO: 7937) |
| KRAS-2560 Target: | 5'-AATCTGTAAATTTTTAACCTA-3' | (SEQ ID NO: 7938) |
| KRAS-2561 Target: | 5'-ATCTGTAAATTTTTAACCTAT-3' | (SEQ ID NO: 7939) |
| KRAS-2617 Target: | 5'-TGTGCAAGAGGTGAAGTTTAT-3' | (SEQ ID NO: 7940) |
| KRAS-2619 Target: | 5'-TGCAAGAGGTGAAGTTTATAT-3' | (SEQ ID NO: 7941) |
| KRAS-2620 Target: | 5'-GCAAGAGGTGAAGTTTATATT-3' | (SEQ ID NO: 7942) |
| KRAS-2622 Target: | 5'-AAGAGGTGAAGTTTATATTTG-3' | (SEQ ID NO: 7943) |
| KRAS-2623 Target: | 5'-AGAGGTGAAGTTTATATTTGA-3' | (SEQ ID NO: 7944) |
| KRAS-2628 Target: | 5'-TGAAGTTTATATTTGAATATC-3' | (SEQ ID NO: 7945) |
| KRAS-2716 Target: | 5'-TGACTTGATGCAGTTTTAATA-3' | (SEQ ID NO: 7946) |
| KRAS-2718 Target: | 5'-ACTTGATGCAGTTTTAATACT-3' | (SEQ ID NO: 7947) |
| KRAS-2869 Target: | 5'-GGGATTTGACCTAATCACTAA-3' | (SEQ ID NO: 7948) |
| KRAS-2875 Target: | 5'-TGACCTAATCACTAATTTTCA-3' | (SEQ ID NO: 7949) |
| KRAS-2944 Target: | 5'-GACAGTAGGATTTTTCAAACC-3' | (SEQ ID NO: 7950) |
| KRAS-2989 Target: | 5'-CCAGTGGAAGGAGAATTTAAT-3' | (SEQ ID NO: 7951) |
| KRAS-2992 Target: | 5'-GTGGAAGGAGAATTTAATAAA-3' | (SEQ ID NO: 7952) |
| KRAS-2994 Target: | 5'-GGAAGGAGAATTTAATAAAGA-3' | (SEQ ID NO: 7953) |
| KRAS-2995 Target: | 5'-GAAGGAGAATTTAATAAAGAT-3' | (SEQ ID NO: 7954) |
| KRAS-2999 Target: | 5'-GAGAATTTAATAAAGATAGTG-3' | (SEQ ID NO: 7955) |
| KRAS-3028 Target: | 5'-ATTCCTTAGGTAATCTATAAC-3' | (SEQ ID NO: 7956) |
| KRAS-3029 Target: | 5'-TTCCTTAGGTAATCTATAACT-3' | (SEQ ID NO: 7957) |
| KRAS-3063 Target: | 5'-GTAACAGTAATACATTCCATT-3' | (SEQ ID NO: 7958) |
| KRAS-3065 Target: | 5'-AACAGTAATACATTCCATTGT-3' | (SEQ ID NO: 7959) |
| KRAS-3066 Target: | 5'-ACAGTAATACATTCCATTGTT-3' | (SEQ ID NO: 7960) |
| KRAS-3067 Target: | 5'-CAGTAATACATTCCATTGTTT-3' | (SEQ ID NO: 7961) |
| KRAS-3077 Target: | 5'-TTCCATTGTTTTAGTAACCAG-3' | (SEQ ID NO: 7962) |
| KRAS-3091 Target: | 5'-TAACCAGAAATCTTCATGCAA-3' | (SEQ ID NO: 7963) |
| KRAS-3101 Target: | 5'-TCTTCATGCAATGAAAAATAC-3' | (SEQ ID NO: 7964) |
| KRAS-3108 Target: | 5'-GCAATGAAAAATACTTTAATT-3' | (SEQ ID NO: 7965) |
| KRAS-3110 Target: | 5'-AATGAAAAATACTTTAATTCA-3' | (SEQ ID NO: 7966) |
| KRAS-3111 Target: | 5'-ATGAAAAATACTTTAATTCAT-3' | (SEQ ID NO: 7967) |
| KRAS-3125 Target: | 5'-AATTCATGAAGCTTACTTTTT-3' | (SEQ ID NO: 7968) |
| KRAS-3128 Target: | 5'-TCATGAAGCTTACTTTTTTTT-3' | (SEQ ID NO: 7969) |
| KRAS-3132 Target: | 5'-GAAGCTTACTTTTTTTTTTG-3' | (SEQ ID NO: 7970) |
| KRAS-3136 Target: | 5'-CTTACTTTTTTTTTTGGTGT-3' | (SEQ ID NO: 7971) |
| KRAS-3137 Target: | 5'-TTACTTTTTTTTTTGGTGTC-3' | (SEQ ID NO: 7972) |
| KRAS-3295 Target: | 5'-TCAACTAATTTTTGTATTTTT-3' | (SEQ ID NO: 7973) |

TABLE 7 -continued

| DsiRNA Target Sequences (21 mers) |
|---|
| KRAS-3298 Target: 5'-ACTAATTTTGTATTTTAGG-3' (SEQ ID NO: 7974) |
| KRAS-3411 Target: 5'-AACTCATTTATTCAGCAAATA-3' (SEQ ID NO: 7975) |
| KRAS-3413 Target: 5'-CTCATTTATTCAGCAAATATT-3' (SEQ ID NO: 7976) |
| KRAS-3415 Target: 5'-CATTTATTCAGCAAATATTTA-3' (SEQ ID NO: 7977) |
| KRAS-3587 Target: 5'-CGTATTTTAGTTTTGCAAAGA-3' (SEQ ID NO: 7978) |
| KRAS-3628 Target: 5'-AGCTCTATAATTGTTTTGCTA-3' (SEQ ID NO: 7979) |
| KRAS-3675 Target: 5'-GCTACTTTATGTAAATCACTT-3' (SEQ ID NO: 7980) |
| KRAS-3676 Target: 5'-CTACTTTATGTAAATCACTTC-3' (SEQ ID NO: 7981) |
| KRAS-3677 Target: 5'-TACTTTATGTAAATCACTTCA-3' (SEQ ID NO: 7982) |
| KRAS-3678 Target: 5'-ACTTTATGTAAATCACTTCAT-3' (SEQ ID NO: 7983) |
| KRAS-3679 Target: 5'-CTTTATGTAAATCACTTCATT-3' (SEQ ID NO: 7984) |
| KRAS-3680 Target: 5'-TTTATGTAAATCACTTCATTG-3' (SEQ ID NO: 7985) |
| KRAS-3681 Target: 5'-TTATGTAAATCACTTCATTGT-3' (SEQ ID NO: 7986) |
| KRAS-3695 Target: 5'-TCATTGTTTTAAAGGAATAAA-3' (SEQ ID NO: 7987) |
| KRAS-3696 Target: 5'-CATTGTTTTAAAGGAATAAAC-3' (SEQ ID NO: 7988) |
| KRAS-3699 Target: 5'-TGTTTTAAAGGAATAAACTTG-3' (SEQ ID NO: 7989) |
| KRAS-3700 Target: 5'-GTTTTAAAGGAATAAACTTGA-3' (SEQ ID NO: 7990) |
| KRAS-3701 Target: 5'-TTTTAAAGGAATAAACTTGAT-3' (SEQ ID NO: 7991) |
| KRAS-3703 Target: 5'-TTAAAGGAATAAACTTGATTA-3' (SEQ ID NO: 7992) |
| KRAS-3704 Target: 5'-TAAAGGAATAAACTTGATTAT-3' (SEQ ID NO: 7993) |
| KRAS-3705 Target: 5'-AAAGGAATAAACTTGATTATA-3' (SEQ ID NO: 7994) |
| KRAS-3706 Target: 5'-AAGGAATAAACTTGATTATAT-3' (SEQ ID NO: 7995) |
| KRAS-3707 Target: 5'-AGGAATAAACTTGATTATATT-3' (SEQ ID NO: 7996) |
| KRAS-3712 Target: 5'-TAAACTTGATTATATTGTTTT-3' (SEQ ID NO: 7997) |
| KRAS-3713 Target: 5'-AAACTTGATTATATTGTTTTT-3' (SEQ ID NO: 7998) |
| KRAS-3716 Target: 5'-CTTGATTATATTGTTTTTTA-3' (SEQ ID NO: 7999) |
| KRAS-3721 Target: 5'-TTATATTGTTTTTTTATTTGG-3' (SEQ ID NO: 8000) |
| KRAS-3722 Target: 5'-TATATTGTTTTTTTATTTGGC-3' (SEQ ID NO: 8001) |
| KRAS-3726 Target: 5'-TTGTTTTTTTATTTGGCATAA-3' (SEQ ID NO: 8002) |
| KRAS-3727 Target: 5'-TGTTTTTTTATTTGGCATAAC-3' (SEQ ID NO: 8003) |
| KRAS-3739 Target: 5'-TGGCATAACTGTGATTCTTTT-3' (SEQ ID NO: 8004) |
| KRAS-3744 Target: 5'-TAACTGTGATTCTTTTAGGAC-3' (SEQ ID NO: 8005) |
| KRAS-3745 Target: 5'-AACTGTGATTCTTTTAGGACA-3' (SEQ ID NO: 8006) |
| KRAS-3781 Target: 5'-AAGGTGTATGTCAGATATTCA-3' (SEQ ID NO: 8007) |
| KRAS-3782 Target: 5'-AGGTGTATGTCAGATATTCAT-3' (SEQ ID NO: 8008) |
| KRAS-3808 Target: 5'-CCCAAATGTGTAATATTCCAG-3' (SEQ ID NO: 8009) |
| KRAS-3836 Target: 5'-TGCATAAGTAATTAAAATATA-3' (SEQ ID NO: 8010) |
| KRAS-3837 Target: 5'-GCATAAGTAATTAAAATATAC-3' (SEQ ID NO: 8011) |
| KRAS-3838 Target: 5'-CATAAGTAATTAAAATATACT-3' (SEQ ID NO: 8012) |

TABLE 7 -continued

| DsiRNA Target Sequences (21 mers) | |
|---|---|
| KRAS-3839 Target: 5'-ATAAGTAATTAAAATATACTT-3' | (SEQ ID NO: 8013) |
| KRAS-3840 Target: 5'-TAAGTAATTAAAATATACTTA-3' | (SEQ ID NO: 8014) |
| KRAS-3841 Target: 5'-AAGTAATTAAAATATACTTAA-3' | (SEQ ID NO: 8015) |
| KRAS-3842 Target: 5'-AGTAATTAAAATATACTTAAA-3' | (SEQ ID NO: 8016) |
| KRAS-3843 Target: 5'-GTAATTAAAATATACTTAAAA-3' | (SEQ ID NO: 8017) |
| KRAS-3844 Target: 5'-TAATTAAAATATACTTAAAAA-3' | (SEQ ID NO: 8018) |
| KRAS-3846 Target: 5'-ATTAAAATATACTTAAAAATT-3' | (SEQ ID NO: 8019) |
| KRAS-3847 Target: 5'-TTAAAATATACTTAAAAATTA-3' | (SEQ ID NO: 8020) |
| KRAS-3848 Target: 5'-TAAAATATACTTAAAAATTAA-3' | (SEQ ID NO: 8021) |
| KRAS-3849 Target: 5'-AAAATATACTTAAAAATTAAT-3' | (SEQ ID NO: 8022) |
| KRAS-3853 Target: 5'-TATACTTAAAAATTAATAGTT-3' | (SEQ ID NO: 8023) |
| KRAS-3857 Target: 5'-CTTAAAAATTAATAGTTTTAT-3' | (SEQ ID NO: 8024) |
| KRAS-3858 Target: 5'-TTAAAAATTAATAGTTTTATC-3' | (SEQ ID NO: 8025) |
| KRAS-3859 Target: 5'-TAAAAATTAATAGTTTTATCT-3' | (SEQ ID NO: 8026) |
| KRAS-3874 Target: 5'-TTATCTGGGTACAAATAAACA-3' | (SEQ ID NO: 8027) |
| KRAS-3913 Target: 5'-CAGACAAGGAAACTTCTATGT-3' | (SEQ ID NO: 8028) |
| KRAS-3914 Target: 5'-AGACAAGGAAACTTCTATGTA-3' | (SEQ ID NO: 8029) |
| KRAS-3915 Target: 5'-GACAAGGAAACTTCTATGTAA-3' | (SEQ ID NO: 8030) |
| KRAS-3924 Target: 5'-ACTTCTATGTAAAAATCACTA-3' | (SEQ ID NO: 8031) |
| KRAS-3925 Target: 5'-CTTCTATGTAAAAATCACTAT-3' | (SEQ ID NO: 8032) |
| KRAS-3926 Target: 5'-TTCTATGTAAAAATCACTATG-3' | (SEQ ID NO: 8033) |
| KRAS-3930 Target: 5'-ATGTAAAAATCACTATGATTT-3' | (SEQ ID NO: 8034) |
| KRAS-3931 Target: 5'-TGTAAAAATCACTATGATTTC-3' | (SEQ ID NO: 8035) |
| KRAS-3940 Target: 5'-CACTATGATTTCTGAATTGCT-3' | (SEQ ID NO: 8036) |
| KRAS-3941 Target: 5'-ACTATGATTTCTGAATTGCTA-3' | (SEQ ID NO: 8037) |
| KRAS-3958 Target: 5'-GCTATGTGAAACTACAGATCT-3' | (SEQ ID NO: 8038) |
| KRAS-3959 Target: 5'-CTATGTGAAACTACAGATCTT-3' | (SEQ ID NO: 8039) |
| KRAS-3995 Target: 5'-GTAGGGTGTTAAGACTTACAC-3' | (SEQ ID NO: 8040) |
| KRAS-4082 Target: 5'-TATTTAGGCCTCTTGAATTTT-3' | (SEQ ID NO: 8041) |
| KRAS-4090 Target: 5'-CCTCTTGAATTTTTGATGTAG-3' | (SEQ ID NO: 8042) |
| KRAS-4091 Target: 5'-CTCTTGAATTTTTGATGTAGA-3' | (SEQ ID NO: 8043) |
| KRAS-4106 Target: 5'-TGTAGATGGGCATTTTTTAA-3' | (SEQ ID NO: 8044) |
| KRAS-4112 Target: 5'-TGGGCATTTTTTAAGGTAGT-3' | (SEQ ID NO: 8045) |
| KRAS-4124 Target: 5'-TAAGGTAGTGGTTAATTACCT-3' | (SEQ ID NO: 8046) |
| KRAS-4126 Target: 5'-AGGTAGTGGTTAATTACCTTT-3' | (SEQ ID NO: 8047) |
| KRAS-4127 Target: 5'-GGTAGTGGTTAATTACCTTTA-3' | (SEQ ID NO: 8048) |
| KRAS-4128 Target: 5'-GTAGTGGTTAATTACCTTTAT-3' | (SEQ ID NO: 8049) |
| KRAS-4129 Target: 5'-TAGTGGTTAATTACCTTTATG-3' | (SEQ ID NO: 8050) |
| KRAS-4139 Target: 5'-TTACCTTTATGTGAACTTTGA-3' | (SEQ ID NO: 8051) |

TABLE 7 -continued

| DsiRNA Target Sequences (21 mers) | |
|---|---|
| KRAS-4144 Target: 5'-TTTATGTGAACTTTGAATGGT-3' | (SEQ ID NO: 8052) |
| KRAS-4150 Target: 5'-TGAACTTTGAATGGTTTAACA-3' | (SEQ ID NO: 8053) |
| KRAS-4154 Target: 5'-CTTTGAATGGTTTAACAAAAG-3' | (SEQ ID NO: 8054) |
| KRAS-4155 Target: 5'-TTTGAATGGTTTAACAAAAGA-3' | (SEQ ID NO: 8055) |
| KRAS-4156 Target: 5'-TTGAATGGTTTAACAAAAGAT-3' | (SEQ ID NO: 8056) |
| KRAS-4157 Target: 5'-TGAATGGTTTAACAAAAGATT-3' | (SEQ ID NO: 8057) |
| KRAS-4158 Target: 5'-GAATGGTTTAACAAAAGATTT-3' | (SEQ ID NO: 8058) |
| KRAS-4160 Target: 5'-ATGGTTTAACAAAAGATTTGT-3' | (SEQ ID NO: 8059) |
| KRAS-4161 Target: 5'-TGGTTTAACAAAAGATTTGTT-3' | (SEQ ID NO: 8060) |
| KRAS-4165 Target: 5'-TTAACAAAAGATTTGTTTTTG-3' | (SEQ ID NO: 8061) |
| KRAS-4166 Target: 5'-TAACAAAAGATTTGTTTTTGT-3' | (SEQ ID NO: 8062) |
| KRAS-4167 Target: 5'-AACAAAAGATTTGTTTTTGTA-3' | (SEQ ID NO: 8063) |
| KRAS-4169 Target: 5'-CAAAAGATTTGTTTTTGTAGA-3' | (SEQ ID NO: 8064) |
| KRAS-4170 Target: 5'-AAAAGATTTGTTTTTGTAGAG-3' | (SEQ ID NO: 8065) |
| KRAS-4171 Target: 5'-AAAGATTTGTTTTTGTAGAGA-3' | (SEQ ID NO: 8066) |
| KRAS-4172 Target: 5'-AAGATTTGTTTTTGTAGAGAT-3' | (SEQ ID NO: 8067) |
| KRAS-4178 Target: 5'-TGTTTTTGTAGAGATTTTAAA-3' | (SEQ ID NO: 8068) |
| KRAS-4195 Target: 5'-TAAAGGGGGAGAATTCTAGAA-3' | (SEQ ID NO: 8069) |
| KRAS-4197 Target: 5'-AAGGGGGAGAATTCTAGAAAT-3' | (SEQ ID NO: 8070) |
| KRAS-4198 Target: 5'-AGGGGGAGAATTCTAGAAATA-3' | (SEQ ID NO: 8071) |
| KRAS-4199 Target: 5'-GGGGGAGAATTCTAGAAATAA-3' | (SEQ ID NO: 8072) |
| KRAS-4200 Target: 5'-GGGGAGAATTCTAGAAATAAA-3' | (SEQ ID NO: 8073) |
| KRAS-4201 Target: 5'-GGGAGAATTCTAGAAATAAAT-3' | (SEQ ID NO: 8074) |
| KRAS-4206 Target: 5'-AATTCTAGAAATAAATGTTAC-3' | (SEQ ID NO: 8075) |
| KRAS-4207 Target: 5'-ATTCTAGAAATAAATGTTACC-3' | (SEQ ID NO: 8076) |
| KRAS-4208 Target: 5'-TTCTAGAAATAAATGTTACCT-3' | (SEQ ID NO: 8077) |
| KRAS-4209 Target: 5'-TCTAGAAATAAATGTTACCTA-3' | (SEQ ID NO: 8078) |
| KRAS-4210 Target: 5'-CTAGAAATAAATGTTACCTAA-3' | (SEQ ID NO: 8079) |
| KRAS-4212 Target: 5'-AGAAATAAATGTTACCTAATT-3' | (SEQ ID NO: 8080) |
| KRAS-4223 Target: 5'-TTACCTAATTATTACAGCCTT-3' | (SEQ ID NO: 8081) |
| KRAS-4224 Target: 5'-TACCTAATTATTACAGCCTTA-3' | (SEQ ID NO: 8082) |
| KRAS-4238 Target: 5'-AGCCTTAAAGACAAAAATCCT-3' | (SEQ ID NO: 8083) |
| KRAS-4241 Target: 5'-CTTAAAGACAAAAATCCTTGT-3' | (SEQ ID NO: 8084) |
| KRAS-4253 Target: 5'-AATCCTTGTTGAAGTTTTTTT-3' | (SEQ ID NO: 8085) |
| KRAS-4254 Target: 5'-ATCCTTGTTGAAGTTTTTTTA-3' | (SEQ ID NO: 8086) |
| KRAS-4256 Target: 5'-CCTTGTTGAAGTTTTTTTAAA-3' | (SEQ ID NO: 8087) |
| KRAS-4257 Target: 5'-CTTGTTGAAGTTTTTTTAAAA-3' | (SEQ ID NO: 8088) |
| KRAS-4261 Target: 5'-TTGAAGTTTTTTTAAAAAAAG-3' | (SEQ ID NO: 8089) |
| KRAS-4262 Target: 5'-TGAAGTTTTTTTAAAAAAAGC-3' | (SEQ ID NO: 8090) |

TABLE 7 -continued

| DsiRNA Target Sequences (21 mers) | | |
|---|---|---|
| KRAS-4263 Target: 5'-GAAGTTTTTTAAAAAAAGCT-3' | (SEQ ID NO: 8091) | |
| KRAS-4264 Target: 5'-AAGTTTTTTAAAAAAAGCTA-3' | (SEQ ID NO: 8092) | |
| KRAS-4265 Target: 5'-AGTTTTTTAAAAAAAGCTAA-3' | (SEQ ID NO: 8093) | |
| KRAS-4269 Target: 5'-TTTTTAAAAAAAGCTAAATTA-3' | (SEQ ID NO: 8094) | |
| KRAS-4271 Target: 5'-TTTAAAAAAAGCTAAATTACA-3' | (SEQ ID NO: 8095) | |
| KRAS-4293 Target: 5'-AGACTTAGGCATTAACATGTT-3' | (SEQ ID NO: 8096) | |
| KRAS-4294 Target: 5'-GACTTAGGCATTAACATGTTT-3' | (SEQ ID NO: 8097) | |
| KRAS-4325 Target: 5'-ATAGCAGACGTATATTGTATC-3' | (SEQ ID NO: 8098) | |
| KRAS-4329 Target: 5'-CAGACGTATATTGTATCATTT-3' | (SEQ ID NO: 8099) | |
| KRAS-4331 Target: 5'-GACGTATATTGTATCATTTGA-3' | (SEQ ID NO: 8100) | |
| KRAS-4334 Target: 5'-GTATATTGTATCATTTGAGTG-3' | (SEQ ID NO: 8101) | |
| KRAS-4335 Target: 5'-TATATTGTATCATTTGAGTGA-3' | (SEQ ID NO: 8102) | |
| KRAS-4336 Target: 5'-ATATTGTATCATTTGAGTGAA-3' | (SEQ ID NO: 8103) | |
| KRAS-4402 Target: 5'-GCATAGGAATTTAGAACCTAA-3' | (SEQ ID NO: 8104) | |
| KRAS-4403 Target: 5'-CATAGGAATTTAGAACCTAAC-3' | (SEQ ID NO: 8105) | |
| KRAS-4407 Target: 5'-GGAATTTAGAACCTAACTTTT-3' | (SEQ ID NO: 8106) | |
| KRAS-4408 Target: 5'-GAATTTAGAACCTAACTTTTA-3' | (SEQ ID NO: 8107) | |
| KRAS-4409 Target: 5'-AATTTAGAACCTAACTTTTAT-3' | (SEQ ID NO: 8108) | |
| KRAS-4410 Target: 5'-ATTTAGAACCTAACTTTTATA-3' | (SEQ ID NO: 8109) | |
| KRAS-4422 Target: 5'-ACTTTTATAGGTTATCAAAAC-3' | (SEQ ID NO: 8110) | |
| KRAS-4424 Target: 5'-TTTTATAGGTTATCAAAACTG-3' | (SEQ ID NO: 8111) | |
| KRAS-4458 Target: 5'-ACAATTTTGTCCTAATATATA-3' | (SEQ ID NO: 8112) | |
| KRAS-4459 Target: 5'-CAATTTTGTCCTAATATATAC-3' | (SEQ ID NO: 8113) | |
| KRAS-4460 Target: 5'-AATTTTGTCCTAATATATACA-3' | (SEQ ID NO: 8114) | |
| KRAS-4466 Target: 5'-GTCCTAATATATACATAGAAA-3' | (SEQ ID NO: 8115) | |
| KRAS-4471 Target: 5'-AATATATACATAGAAACTTTG-3' | (SEQ ID NO: 8116) | |
| KRAS-4514 Target: 5'-TGCACAAGTTCATCTCATTTG-3' | (SEQ ID NO: 8117) | |
| KRAS-4525 Target: 5'-ATCTCATTTGTATTCCATTGA-3' | (SEQ ID NO: 8118) | |
| KRAS-4526 Target: 5'-TCTCATTTGTATTCCATTGAT-3' | (SEQ ID NO: 8119) | |
| KRAS-4527 Target: 5'-CTCATTTGTATTCCATTGATT-3' | (SEQ ID NO: 8120) | |
| KRAS-4528 Target: 5'-TCATTTGTATTCCATTGATTT-3' | (SEQ ID NO: 8121) | |
| KRAS-4529 Target: 5'-CATTTGTATTCCATTGATTTT-3' | (SEQ ID NO: 8122) | |
| KRAS-4530 Target: 5'-ATTTGTATTCCATTGATTTTT-3' | (SEQ ID NO: 8123) | |
| KRAS-4531 Target: 5'-TTTGTATTCCATTGATTTTTT-3' | (SEQ ID NO: 8124) | |
| KRAS-4538 Target: 5'-TCCATTGATTTTTTTTCTT-3' | (SEQ ID NO: 8125) | |
| KRAS-4539 Target: 5'-CCATTGATTTTTTTTCTTC-3' | (SEQ ID NO: 8126) | |
| KRAS-4543 Target: 5'-TGATTTTTTTTCTTCTAAA-3' | (SEQ ID NO: 8127) | |
| KRAS-4544 Target: 5'-GATTTTTTTTCTTCTAAAC-3' | (SEQ ID NO: 8128) | |
| KRAS-4545 Target: 5'-ATTTTTTTTCTTCTAAACA-3' | (SEQ ID NO: 8129) | |

TABLE 7 -continued

| DsiRNA Target Sequences (21 mers) | |
|---|---|
| KRAS-4546 Target: 5'-TTTTTTTTTCTTCTAAACAT-3' | (SEQ ID NO: 8130) |
| KRAS-4547 Target: 5'-TTTTTTTTCTTCTAAACATT-3' | (SEQ ID NO: 8131) |
| KRAS-4560 Target: 5'-TAAACATTTTTCTTCAAACA-3' | (SEQ ID NO: 8132) |
| KRAS-4561 Target: 5'-AAACATTTTTCTTCAAACAG-3' | (SEQ ID NO: 8133) |
| KRAS-4562 Target: 5'-AACATTTTTCTTCAAACAGT-3' | (SEQ ID NO: 8134) |
| KRAS-4563 Target: 5'-ACATTTTTCTTCAAACAGTA-3' | (SEQ ID NO: 8135) |
| KRAS-4564 Target: 5'-CATTTTTCTTCAAACAGTAT-3' | (SEQ ID NO: 8136) |
| KRAS-4571 Target: 5'-TCTTCAAACAGTATATAACTT-3' | (SEQ ID NO: 8137) |
| KRAS-4576 Target: 5'-AAACAGTATATAACTTTTTT-3' | (SEQ ID NO: 8138) |
| KRAS-4577 Target: 5'-AACAGTATATAACTTTTTTA-3' | (SEQ ID NO: 8139) |
| KRAS-4578 Target: 5'-ACAGTATATAACTTTTTTAG-3' | (SEQ ID NO: 8140) |
| KRAS-4579 Target: 5'-CAGTATATAACTTTTTTAGG-3' | (SEQ ID NO: 8141) |
| KRAS-4585 Target: 5'-ATAACTTTTTTAGGGGATTT-3' | (SEQ ID NO: 8142) |
| KRAS-4586 Target: 5'-TAACTTTTTTAGGGGATTTT-3' | (SEQ ID NO: 8143) |
| KRAS-4597 Target: 5'-AGGGGATTTTTTTTAGACAG-3' | (SEQ ID NO: 8144) |
| KRAS-4598 Target: 5'-GGGGATTTTTTTTAGACAGC-3' | (SEQ ID NO: 8145) |
| KRAS-4599 Target: 5'-GGGATTTTTTTTAGACAGCA-3' | (SEQ ID NO: 8146) |
| KRAS-4627 Target: 5'-TCTGAAGATTTCCATTTGTCA-3' | (SEQ ID NO: 8147) |
| KRAS-4628 Target: 5'-CTGAAGATTTCCATTTGTCAA-3' | (SEQ ID NO: 8148) |
| KRAS-4629 Target: 5'-TGAAGATTTCCATTTGTCAAA-3' | (SEQ ID NO: 8149) |
| KRAS-4630 Target: 5'-GAAGATTTCCATTTGTCAAAA-3' | (SEQ ID NO: 8150) |
| KRAS-4635 Target: 5'-TTTCCATTTGTCAAAAGTAA-3' | (SEQ ID NO: 8151) |
| KRAS-4636 Target: 5'-TTCCATTTGTCAAAAGTAAT-3' | (SEQ ID NO: 8152) |
| KRAS-4637 Target: 5'-TCCATTTGTCAAAAGTAATG-3' | (SEQ ID NO: 8153) |
| KRAS-4642 Target: 5'-TTGTCAAAAGTAATGATTTC-3' | (SEQ ID NO: 8154) |
| KRAS-4643 Target: 5'-TGTCAAAAGTAATGATTTCT-3' | (SEQ ID NO: 8155) |
| KRAS-4644 Target: 5'-GTCAAAAGTAATGATTTCTT-3' | (SEQ ID NO: 8156) |
| KRAS-4645 Target: 5'-TCAAAAGTAATGATTTCTTG-3' | (SEQ ID NO: 8157) |
| KRAS-4647 Target: 5'-AAAAAGTAATGATTTCTTGAT-3' | (SEQ ID NO: 8158) |
| KRAS-4649 Target: 5'-AAAGTAATGATTTCTTGATAA-3' | (SEQ ID NO: 8159) |
| KRAS-4650 Target: 5'-AAGTAATGATTTCTTGATAAT-3' | (SEQ ID NO: 8160) |
| KRAS-4652 Target: 5'-GTAATGATTTCTTGATAATTG-3' | (SEQ ID NO: 8161) |
| KRAS-4653 Target: 5'-TAATGATTTCTTGATAATTGT-3' | (SEQ ID NO: 8162) |
| KRAS-4658 Target: 5'-ATTTCTTGATAATTGTGTAGT-3' | (SEQ ID NO: 8163) |
| KRAS-4659 Target: 5'-TTTCTTGATAATTGTGTAGTA-3' | (SEQ ID NO: 8164) |
| KRAS-4660 Target: 5'-TTCTTGATAATTGTGTAGTAA-3' | (SEQ ID NO: 8165) |
| KRAS-4662 Target: 5'-CTTGATAATTGTGTAGTAATG-3' | (SEQ ID NO: 8166) |
| KRAS-4665 Target: 5'-GATAATTGTGTAGTAATGTTT-3' | (SEQ ID NO: 8167) |
| KRAS-4667 Target: 5'-TAATTGTGTAGTAATGTTTTT-3' | (SEQ ID NO: 8168) |

TABLE 7 -continued

| DsiRNA Target Sequences (21 mers) |
| --- |

KRAS-4668 Target: 5'-AATTGTGTAGTAATGTTTTTT-3'  (SEQ ID NO: 8169)

KRAS-4702 Target: 5'-TACCTTAAAGCTGAATTTATA-3'  (SEQ ID NO: 8170)

KRAS-4704 Target: 5'-CCTTAAAGCTGAATTTATATT-3'  (SEQ ID NO: 8171)

KRAS-4713 Target: 5'-TGAATTTATATTTAGTAACTT-3'  (SEQ ID NO: 8172)

KRAS-4714 Target: 5'-GAATTTATATTTAGTAACTTC-3'  (SEQ ID NO: 8173)

KRAS-4715 Target: 5'-AATTTATATTTAGTAACTTCT-3'  (SEQ ID NO: 8174)

KRAS-4720 Target: 5'-ATATTTAGTAACTTCTGTGTT-3'  (SEQ ID NO: 8175)

KRAS-4771 Target: 5'-AAACTGAATAGCTGTCATAAA-3'  (SEQ ID NO: 8176)

KRAS-4772 Target: 5'-AACTGAATAGCTGTCATAAAA-3'  (SEQ ID NO: 8177)

KRAS-4786 Target: 5'-CATAAAATGAAACTTTCTTTC-3'  (SEQ ID NO: 8178)

KRAS-4787 Target: 5'-ATAAAATGAAACTTTCTTTCT-3'  (SEQ ID NO: 8179)

KRAS-4788 Target: 5'-TAAAATGAAACTTTCTTTCTA-3'  (SEQ ID NO: 8180)

KRAS-4790 Target: 5'-AAATGAAACTTTCTTTCTAAA-3'  (SEQ ID NO: 8181)

KRAS-4794 Target: 5'-GAAACTTTCTTTCTAAAGAAA-3'  (SEQ ID NO: 8182)

KRAS-4819 Target: 5'-CTCACATGAGTTCTTGAAGAA-3'  (SEQ ID NO: 8183)

KRAS-4828 Target: 5'-GTTCTTGAAGAATAGTCATAA-3'  (SEQ ID NO: 8184)

KRAS-4829 Target: 5'-TTCTTGAAGAATAGTCATAAC-3'  (SEQ ID NO: 8185)

KRAS-4830 Target: 5'-TCTTGAAGAATAGTCATAACT-3'  (SEQ ID NO: 8186)

KRAS-4833 Target: 5'-TGAAGAATAGTCATAACTAGA-3'  (SEQ ID NO: 8187)

KRAS-4834 Target: 5'-GAAGAATAGTCATAACTAGAT-3'  (SEQ ID NO: 8188)

KRAS-4835 Target: 5'-AAGAATAGTCATAACTAGATT-3'  (SEQ ID NO: 8189)

KRAS-4836 Target: 5'-AGAATAGTCATAACTAGATTA-3'  (SEQ ID NO: 8190)

KRAS-4840 Target: 5'-TAGTCATAACTAGATTAAGAT-3'  (SEQ ID NO: 8191)

KRAS-4846 Target: 5'-TAACTAGATTAAGATCTGTGT-3'  (SEQ ID NO: 8192

KRAS-4848 Target: 5'-ACTAGATTAAGATCTGTGTTT-3'  (SEQ ID NO: 8193)

KRAS-4849 Target: 5'-CTAGATTAAGATCTGTGTTTT-3'  (SEQ ID NO: 8194)

KRAS-4851 Target: 5'-AGATTAAGATCTGTGTTTTAG-3'  (SEQ ID NO: 8195)

KRAS-4858 Target: 5'-GATCTGTGTTTTAGTTTAATA-3'  (SEQ ID NO: 8196)

KRAS-4859 Target: 5'-ATCTGTGTTTTAGTTTAATAG-3'  (SEQ ID NO: 8197)

KRAS-4861 Target: 5'-CTGTGTTTTAGTTTAATAGTT-3'  (SEQ ID NO: 8198)

KRAS-4863 Target: 5'-GTGTTTTAGTTTAATAGTTTG-3'  (SEQ ID NO: 8199)

KRAS-4864 Target: 5'-TGTTTTAGTTTAATAGTTTGA-3'  (SEQ ID NO: 8200)

KRAS-4890 Target: 5'-CTGTTTGGGATAATGATAGGT-3'  (SEQ ID NO: 8201)

KRAS-4892 Target: 5'-GTTTGGGATAATGATAGGTAA-3'  (SEQ ID NO: 8202)

KRAS-4895 Target: 5'-TGGGATAATGATAGGTAATTT-3'  (SEQ ID NO: 8203)

KRAS-4896 Target: 5'-GGGATAATGATAGGTAATTTA-3'  (SEQ ID NO: 8204)

KRAS-4899 Target: 5'-ATAATGATAGGTAATTTAGAT-3'  (SEQ ID NO: 8205)

KRAS-4900 Target: 5'-TAATGATAGGTAATTTAGATG-3'  (SEQ ID NO: 8206)

KRAS-4905 Target: 5'-ATAGGTAATTTAGATGAATTT-3'  (SEQ ID NO: 8207)

TABLE 7 -continued

| DsiRNA Target Sequences (21 mers) | | |
|---|---|---|
| KRAS-4907 Target: 5'-AGGTAATTTAGATGAATTTAG-3' | (SEQ ID NO: 8208) |
| KRAS-4914 Target: 5'-TTAGATGAATTTAGGGGAAAA-3' | (SEQ ID NO: 8209) |
| KRAS-4915 Target: 5'-TAGATGAATTTAGGGGAAAAA-3' | (SEQ ID NO: 8210) |
| KRAS-4926 Target: 5'-AGGGGAAAAAAAAGTTATCTG-3' | (SEQ ID NO: 8211) |
| KRAS-4927 Target: 5'-GGGGAAAAAAAAGTTATCTGC-3' | (SEQ ID NO: 8212) |
| KRAS-4932 Target: 5'-AAAAAAGTTATCTGCAGATA-3' | (SEQ ID NO: 8213) |
| KRAS-5033 Target: 5'-CTGTCTTGTGTTTTCATGTTG-3' | (SEQ ID NO: 8214) |
| KRAS-5034 Target: 5'-TGTCTTGTGTTTTCATGTTGA-3' | (SEQ ID NO: 8215) |
| KRAS-5035 Target: 5'-GTCTTGTGTTTTCATGTTGAA-3' | (SEQ ID NO: 8216) |
| KRAS-5045 Target: 5'-TTCATGTTGAAAATACTTTTG-3' | (SEQ ID NO: 8217) |
| KRAS-5046 Target: 5'-TCATGTTGAAAATACTTTTGC-3' | (SEQ ID NO: 8218) |
| KRAS-5047 Target: 5'-CATGTTGAAAATACTTTTGCA-3' | (SEQ ID NO: 8219) |
| KRAS-5048 Target: 5'-ATGTTGAAAATACTTTTGCAT-3' | (SEQ ID NO: 8220) |
| KRAS-5058 Target: 5'-TACTTTTGCATTTTTCCTTTG-3' | (SEQ ID NO: 8221) |
| KRAS-5075 Target: 5'-TTTGAGTGCCAATTTCTTACT-3' | (SEQ ID NO: 8222) |
| KRAS-5080 Target: 5'-GTGCCAATTTCTTACTAGTAC-3' | (SEQ ID NO: 8223) |
| KRAS-5081 Target: 5'-TGCCAATTTCTTACTAGTACT-3' | (SEQ ID NO: 8224) |
| KRAS-5090 Target: 5'-CTTACTAGTACTATTTCTTAA-3' | (SEQ ID NO: 8225) |
| KRAS-5091 Target: 5'-TTACTAGTACTATTTCTTAAT-3' | (SEQ ID NO: 8226) |
| KRAS-5096 Target: 5'-AGTACTATTTCTTAATGTAAC-3' | (SEQ ID NO: 8227) |
| KRAS-5097 Target: 5'-GTACTATTTCTTAATGTAACA-3' | (SEQ ID NO: 8228) |
| KRAS-5098 Target: 5'-TACTATTTCTTAATGTAACAT-3' | (SEQ ID NO: 8229) |
| KRAS-5105 Target: 5'-TCTTAATGTAACATGTTTACC-3' | (SEQ ID NO: 8230) |
| KRAS-5122 Target: 5'-TACCTGGAATGTATTTTAACT-3' | (SEQ ID NO: 8231) |
| KRAS-5124 Target: 5'-CCTGGAATGTATTTTAACTAT-3' | (SEQ ID NO: 8232) |
| KRAS-5125 Target: 5'-CTGGAATGTATTTTAACTATT-3' | (SEQ ID NO: 8233) |
| KRAS-5126 Target: 5'-TGGAATGTATTTTAACTATTT-3' | (SEQ ID NO: 8234) |
| KRAS-5127 Target: 5'-GGAATGTATTTTAACTATTTT-3' | (SEQ ID NO: 8235) |
| KRAS-5129 Target: 5'-AATGTATTTTAACTATTTTTG-3' | (SEQ ID NO: 8236) |
| KRAS-5131 Target: 5'-TGTATTTTAACTATTTTGTA-3' | (SEQ ID NO: 8237) |
| KRAS-5132 Target: 5'-GTATTTTAACTATTTTGTAT-3' | (SEQ ID NO: 8238) |
| KRAS-5133 Target: 5'-TATTTTAACTATTTTGTATA-3' | (SEQ ID NO: 8239) |
| KRAS-5140 Target: 5'-ACTATTTTGTATAGTGTAAA-3' | (SEQ ID NO: 8240) |
| KRAS-5141 Target: 5'-CTATTTTGTATAGTGTAAAC-3' | (SEQ ID NO: 8241) |
| KRAS-5142 Target: 5'-TATTTTGTATAGTGTAAACT-3' | (SEQ ID NO: 8242) |
| KRAS-5157 Target: 5'-TAAACTGAAACATGCACATTT-3' | (SEQ ID NO: 8243) |
| KRAS-5163 Target: 5'-GAAACATGCACATTTTGTACA-3' | (SEQ ID NO: 8244) |
| KRAS-5216 Target: 5'-GATCCAGTTGTTTTCCATCAT-3' | (SEQ ID NO: 8245) |
| KRAS-5218 Target: 5'-TCCAGTTGTTTTCCATCATTT-3' | (SEQ ID NO: 8246) |

TABLE 7 -continued

| DsiRNA Target Sequences (21 mers) | | |
|---|---|---|
| KRAS-5255 Target: | 5'-GAATGTTGGTCATATCAAACA-3' | (SEQ ID NO: 8247) |
| KRAS-5256 Target: | 5'-AATGTTGGTCATATCAAACAT-3' | (SEQ ID NO: 8248) |
| KRAS-5257 Target: | 5'-ATGTTGGTCATATCAAACATT-3' | (SEQ ID NO: 8249) |
| KRAS-5261 Target: | 5'-TGGTCATATCAAACATTAAAA-3' | (SEQ ID NO: 8250) |
| KRAS-5277 Target: | 5'-TAAAAATGACCACTCTTTTAA-3' | (SEQ ID NO: 8251) |
| KRAS-5278 Target: | 5'-AAAAATGACCACTCTTTTAAT-3' | (SEQ ID NO: 8252) |
| KRAS-5287 Target: | 5'-CACTCTTTTAATTGAAATTAA-3' | (SEQ ID NO: 8253) |
| KRAS-5288 Target: | 5'-ACTCTTTTAATTGAAATTAAC-3' | (SEQ ID NO: 8254) |
| KRAS-5290 Target: | 5'-TCTTTTAATTGAAATTAACTT-3' | (SEQ ID NO: 8255) |
| KRAS-5292 Target: | 5'-TTTTAATTGAAATTAACTTTT-3' | (SEQ ID NO: 8256) |
| KRAS-5293 Target: | 5'-TTTAATTGAAATTAACTTTTA-3' | (SEQ ID NO: 8257) |
| KRAS-5294 Target: | 5'-TTAATTGAAATTAACTTTTAA-3' | (SEQ ID NO: 8258) |
| KRAS-5295 Target: | 5'-TAATTGAAATTAACTTTTAAA-3' | (SEQ ID NO: 8259) |
| KRAS-5296 Target: | 5'-AATTGAAATTAACTTTTAAAT-3' | (SEQ ID.NO: 8260) |
| KRAS-5297 Target: | 5'-ATTGAAATTAACTTTTAAATG-3' | (SEQ ID NO: 8261) |
| KRAS-5300 Target: | 5'-GAAATTAACTTTTAAATGTTT-3' | (SEQ ID NO: 8262) |
| KRAS-5304 Target: | 5'-TTAACTTTTAAATGTTTATAG-3' | (SEQ ID NO: 8263) |
| KRAS-5308 Target: | 5'-CTTTTAAATGTTTATAGGAGT-3' | (SEQ ID NO: 8264) |
| KRAS-5309 Target: | 5'-TTTTAAATGTTTATAGGAGTA-3' | (SEQ ID NO: 8265) |
| KRAS-5331 Target: | 5'-GTGCTGTGAAGTGATCTAAAA-3' | (SEQ ID NO: 8266) |
| KRAS-5333 Target: | 5'-GCTGTGAAGTGATCTAAAATT-3' | (SEQ ID NO: 8267) |
| KRAS-5334 Target: | 5'-CTGTGAAGTGATCTAAAATTT-3' | (SEQ ID NO: 8268) |
| KRAS-5335 Target: | 5'-TGTGAAGTGATCTAAAATTTG-3' | (SEQ ID NO: 8269) |
| KRAS-5336 Target: | 5'-GTGAAGTGATCTAAAATTTGT-3' | (SEQ ID NO: 8270) |
| KRAS-5337 Target: | 5'-TGAAGTGATCTAAAATTTGTA-3' | (SEQ ID NO: 8271) |
| KRAS-5338 Target: | 5'-GAAGTGATCTAAAATTTGTAA-3' | (SEQ ID NO: 8272) |
| KRAS-5342 Target: | 5'-TGATCTAAAATTTGTAATATT-3' | (SEQ ID NO: 8273) |
| KRAS-5343 Target: | 5'-GATCTAAAATTTGTAATATTT-3' | (SEQ ID NO: 8274) |
| KRAS-5347 Target: | 5'-TAAAATTTGTAATATTTTGT-3' | (SEQ ID NO: 8275) |
| KRAS-5348 Target: | 5'-AAAATTTGTAATATTTTGTC-3' | (SEQ ID NO: 8276) |
| KRAS-5349 Target: | 5'-AAATTTGTAATATTTTGTCA-3' | (SEQ ID NO: 8277) |
| KRAS-5353 Target: | 5'-TTGTAATATTTTGTCATGAA-3' | (SEQ ID NO: 8278) |
| KRAS-5354 Target: | 5'-TGTAATATTTTGTCATGAAC-3' | (SEQ ID NO: 8279) |
| KRAS-5370 Target: | 5'-TGAACTGTACTACTCCTAATT-3' | (SEQ ID NO: 8280) |
| KRAS-5371 Target: | 5'-GAACTGTACTACTCCTAATTA-3' | (SEQ ID NO: 8281) |
| KRAS-5381 Target: | 5'-ACTCCTAATTATTGTAATGTA-3' | (SEQ ID NO: 8282) |
| KRAS-5382 Target: | 5'-CTCCTAATTATTGTAATGTAA-3' | (SEQ ID NO: 8283) |
| KRAS-5384 Target: | 5'-CCTAATTATTGTAATGTAATA-3' | (SEQ ID NO: 8284) |
| KRAS-5386 Target: | 5'-TAATTATTGTAATGTAATAAA-3' | (SEQ ID NO: 8285) |

TABLE 7 -continued

| DsiRNA Target Sequences (21 mers) | | |
|---|---|---|
| KRAS-5387 Target: | 5'-AATTATTGTAATGTAATAAAA-3' | (SEQ ID NO: 8286) |
| KRAS-5389 Target: | 5'-TTATTGTAATGTAATAAAAAT-3' | (SEQ ID NO: 8287) |
| KRAS-5390 Target: | 5'-TATTGTAATGTAATAAAAATA-3' | (SEQ ID NO: 8288) |
| KRAS-5394 Target: | 5'-GTAATGTAATAAAAATAGTTA-3' | (SEQ ID NO: 8289) |
| KRAS-5395 Target: | 5'-TAATGTAATAAAAATAGTTAC-3' | (SEQ ID NO: 8290) |
| KRAS-5396 Target: | 5'-AATGTAATAAAAATAGTTACA-3' | (SEQ ID NO: 8291) |
| KRAS-5404 Target: | 5'-AAAAATAGTTACAGTGACAAA-3' | (SEQ ID NO: 8292) |
| KRAS-5405 Target: | 5'-AAAATAGTTACAGTGACAAAA-3' | (SEQ ID NO: 8293) |
| KRAS-5407 Target: | 5'-AATAGTTACAGTGACAAAAAA-3' | (SEQ ID NO: 8294) |
| KRAS-166  Target: | 5'-GAGAGGCCTGCTGAAAATGAC-3' | (SEQ ID NO: 8295) |
| KRAS-167  Target: | 5'-AGAGGCCTGCTGAAAATGACT-3' | (SEQ ID NO: 8296) |
| KRAS-168  Target: | 5'-GAGGCCTGCTGAAAATGACTG-3' | (SEQ ID NO: 8297) |
| KRAS-169  Target: | 5'-AGGCCTGCTGAAAATGACTGA-3' | (SEQ ID NO: 8298) |
| KRAS-204  Target: | 5'-TAGTTGGAGCTGGTGGCGTAG-3' | (SEQ ID NO: 8299) |
| KRAS-205  Target: | 5'-AGTTGGAGCTGGTGGCGTAGG-3' | (SEQ ID NO: 8300) |
| KRAS-206  Target: | 5'-GTTGGAGCTGGTGGCGTAGGC-3' | (SEQ ID NO: 8301) |
| KRAS-207  Target: | 5'-TTGGAGCTGGTGGCGTAGGCA-3' | (SEQ ID NO: 8302) |
| KRAS-208  Target: | 5'-TGGAGCTGGTGGCGTAGGCAA-3' | (SEQ ID NO: 8303) |
| KRAS-209  Target: | 5'-GGAGCTGGTGGCGTAGGCAAG-3' | (SEQ ID NO: 8304) |
| KRAS-210  Target: | 5'-GAGCTGGTGGCGTAGGCAAGA-3' | (SEQ ID NO: 8305) |
| KRAS-241  Target: | 5'-GATACAGCTAATTCAGAATCA-3' | (SEQ ID NO: 8306) |
| KRAS-313  Target: | 5'-AGTAATTGATGGAGAAACCTG-3' | (SEQ ID NO: 8307) |
| KRAS-314  Target: | 5'-GTAATTGATGGAGAAACCTGT-3' | (SEQ ID NO: 8308) |
| KRAS-318  Target: | 5'-TTGATGGAGAAACCTGTCTCT-3' | (SEQ ID NO: 8309) |
| KRAS-328  Target: | 5'-AACCTGTCTCTTGGATATTCT-3' | (SEQ ID NO: 8310) |
| KRAS-330  Target: | 5'-CCTGTCTCTTGGATATTCTCG-3' | (SEQ ID NO: 8311) |
| KRAS-331  Target: | 5'-CTGTCTCTTGGATATTCTCGA-3' | (SEQ ID NO: 8312) |
| KRAS-332  Target: | 5'-TGTCTCTTGGATATTCTCGAC-3' | (SEQ ID NO: 8313) |
| KRAS-333  Target: | 5'-GTCTCTTGGATATTCTCGACA-3' | (SEQ ID NO: 8314) |
| KRAS-334  Target: | 5'-TCTCTTGGATATTCTCGACAC-3' | (SEQ ID NO: 8315) |
| KRAS-335  Target: | 5'-CTCTTGGATATTCTCGACACA-3' | (SEQ ID NO: 8316) |
| KRAS-336  Target: | 5'-TCTTGGATATTCTCGACACAG-3' | (SEQ ID NO: 8317) |
| KRAS-352  Target: | 5'-CACAGCAGGTCAAGAGGAGTA-3' | (SEQ ID NO: 8318) |
| KRAS-353  Target: | 5'-ACAGCAGGTCAAGAGGAGTAC-3' | (SEQ ID NO: 8319) |
| KRAS-354  Target: | 5'-CAGCAGGTCAAGAGGAGTACA-3' | (SEQ ID NO: 8320) |
| KRAS-364  Target: | 5'-AGAGGAGTACAGTGCAATGAG-3' | (SEQ ID NO: 8321) |
| KRAS-365  Target: | 5'-GAGGAGTACAGTGCAATGAGG-3' | (SEQ ID NO: 8322) |
| KRAS-366  Target: | 5'-AGGAGTACAGTGCAATGAGGG-3' | (SEQ ID NO: 8323) |
| KRAS-367  Target: | 5'-GGAGTACAGTGCAATGAGGGA-3' | (SEQ ID NO: 8324) |

TABLE 7 -continued

| DsiRNA Target Sequences (21 mers) | | |
|---|---|---|
| KRAS-368 | Target: 5'-GAGTACAGTGCAATGAGGGAC-3' | (SEQ ID NO: 8325) |
| KRAS-369 | Target: 5'-AGTACAGTGCAATGAGGGACC-3' | (SEQ ID NO: 8326) |
| KRAS-370 | Target: 5'-GTACAGTGCAATGAGGGACCA-3' | (SEQ ID NO: 8327) |
| KRAS-371 | Target: 5'-TACAGTGCAATGAGGGACCAG-3' | (SEQ ID NO: 8328) |
| KRAS-372 | Target: 5'-ACAGTGCAATGAGGGACCAGT-3' | (SEQ ID NO: 8329) |
| KRAS-420 | Target: 5'-GTGTATTTGCCATAAATAATA-3' | (SEQ ID NO: 8330) |
| KRAS-421 | Target: 5'-TGTATTTGCCATAAATAATAC-3' | (SEQ ID NO: 8331) |
| KRAS-422 | Target: 5'-GTATTTGCCATAAATAATACT-3' | (SEQ ID NO: 8332) |
| KRAS-423 | Target: 5'-TATTTGCCATAAATAATACTA-3' | (SEQ ID NO: 8333) |
| KRAS-424 | Target: 5'-ATTTGCCATAAATAATACTAA-3' | (SEQ ID NO: 8334) |
| KRAS-425 | Target: 5'-TTTGCCATAAATAATACTAAA-3' | (SEQ ID NO: 8335) |
| KRAS-426 | Target: 5'-TTGCCATAAATAATACTAAAT-3' | (SEQ ID NO: 8336) |
| KRAS-436 | Target: 5'-TAATACTAAATCATTTGAAGA-3' | (SEQ ID NO: 8337) |
| KRAS-437 | Target: 5'-AATACTAAATCATTTGAAGAT-3' | (SEQ ID NO: 8338) |
| KRAS-438 | Target: 5'-ATACTAAATCATTTGAAGATA-3' | (SEQ ID NO: 8339) |
| KRAS-439 | Target: 5'-TACTAAATCATTTGAAGATAT-3' | (SEQ ID NO: 8340) |
| KRAS-440 | Target: 5'-ACTAAATCATTTGAAGATATT-3' | (SEQ ID NO: 8341) |
| KRAS-441 | Target: 5'-CTAAATCATTTGAAGATATTC-3' | (SEQ ID NO: 8342) |
| KRAS-442 | Target: 5'-TAAATCATTTGAAGATATTCA-3' | (SEQ ID NO: 8343) |
| KRAS-443 | Target: 5'-AAATCATTTGAAGATATTCAC-3' | (SEQ ID NO: 8344) |
| KRAS-444 | Target: 5'-AATCATTTGAAGATATTCACC-3' | (SEQ ID NO: 8345) |
| KRAS-454 | Target: 5'-AGATATTCACCATTATAGAGA-3' | (SEQ ID NO: 8346) |
| KRAS-455 | Target: 5'-GATATTCACCATTATAGAGAA-3' | (SEQ ID NO: 8347) |
| KRAS-456 | Target: 5'-ATATTCACCATTATAGAGAAC-3' | (SEQ ID NO: 8348) |
| KRAS-457 | Target: 5'-TATTCACCATTATAGAGAACA-3' | (SEQ ID NO: 8349) |
| KRAS-458 | Target: 5'-ATTCACCATTATAGAGAACAA-3' | (SEQ ID NO: 8350) |
| KRAS-459 | Target: 5'-TTCACCATTATAGAGAACAAA-3' | (SEQ ID NO: 8351) |
| KRAS-460 | Target: 5'-TCACCATTATAGAGAACAAAT-3' | (SEQ ID NO: 8352) |
| KRAS-461 | Target: 5'-CACCATTATAGAGAACAAATT-3' | (SEQ ID NO: 8353) |
| KRAS-462 | Target: 5'-ACCATTATAGAGAACAAATTA-3' | (SEQ ID NO: 8354) |
| KRAS-508 | Target: 5'-ACCTATGGTCCTAGTAGGAAA-3' | (SEQ ID NO: 8355) |
| KRAS-531 | Target: 5'-AATGTGATTTGCCTTCTAGAA-3' | (SEQ ID NO: 8356) |
| KRAS-532 | Target: 5'-ATGTGATTTGCCTTCTAGAAC-3' | (SEQ ID NO: 8357) |
| KRAS-534 | Target: 5'-GTGATTTGCCTTCTAGAACAG-3' | (SEQ ID NO: 8358) |
| KRAS-586 | Target: 5'-AAGTTATGGAATTCCTTTTAT-3' | (SEQ ID NO: 8359) |
| KRAS-587 | Target: 5'-AGTTATGGAATTCCTTTTATT-3' | (SEQ ID NO: 8360) |
| KRAS-588 | Target: 5'-GTTATGGAATTCCTTTTATTG-3' | (SEQ ID NO: 8361) |
| KRAS-763 | Target: 5'-ATGATGCCTTCTATACATTAG-3' | (SEQ ID NO: 8362) |
| KRAS-764 | Target: 5'-TGATGCCTTCTATACATTAGT-3' | (SEQ ID NO: 8363) |

TABLE 7 -continued

| DsiRNA Target Sequences (21 mers) | | |
|---|---|---|
| KRAS-784 Target: | 5'-TTCGAGAAATTCGAAAACATA-3' | (SEQ ID NO: 8364) |
| KRAS-794 Target: | 5'-TCGAAAACATAAAGAAAAGAT-3' | (SEQ ID NO: 8365) |
| KRAS-795 Target: | 5'-CGAAAACATAAAGAAAAGATG-3' | (SEQ ID NO: 8366) |
| KRAS-796 Target: | 5'-GAAAACATAAAGAAAAGATGA-3' | (SEQ ID NO: 8367) |
| KRAS-797 Target: | 5'-AAAACATAAAGAAAAGATGAG-3' | (SEQ ID NO: 8368) |
| KRAS-798 Target: | 5'-AAACATAAAGAAAAGATGAGC-3' | (SEQ ID NO: 8369) |
| KRAS-799 Target: | 5'-AACATAAAGAAAAGATGAGCA-3' | (SEQ ID NO: 8370) |
| KRAS-800 Target: | 5'-ACATAAAGAAAAGATGAGCAA-3' | (SEQ ID NO: 8371) |
| KRAS-801 Target: | 5'-CATAAAGAAAAGATGAGCAAA-3' | (SEQ ID NO: 8372) |
| KRAS-802 Target: | 5'-ATAAAGAAAAGATGAGCAAAG-3' | (SEQ ID NO: 8373) |
| KRAS-908 Target: | 5'-ACAAGTGGTAATTTTGTACA-3' | (SEQ ID NO: 8374) |
| KRAS-909 Target: | 5'-CAAGTGGTAATTTTGTACAT-3' | (SEQ ID NO: 8375) |
| KRAS-920 Target: | 5'-TTTTGTACATTACACTAAATT-3' | (SEQ ID NO: 8376) |
| KRAS-921 Target: | 5'-TTTGTACATTACACTAAATTA-3' | (SEQ ID NO: 8377) |
| KRAS-922 Target: | 5'-TTGTACATTACACTAAATTAT-3' | (SEQ ID NO: 8378) |
| KRAS-923 Target: | 5'-TGTACATTACACTAAATTATT-3' | (SEQ ID NO: 8379) |
| KRAS-924 Target: | 5'-GTACATTACACTAAATTATTA-3' | (SEQ ID NO: 8380) |
| KRAS-925 Target: | 5'-TACATTACACTAAATTATTAG-3' | (SEQ ID NO: 8381) |
| KRAS-926 Target: | 5'-ACATTACACTAAATTATTAGC-3' | (SEQ ID NO: 8382) |
| KRAS-927 Target: | 5'-CATTACACTAAATTATTAGCA-3' | (SEQ ID NO: 8383) |
| KRAS-928 Target: | 5'-ATTACACTAAATTATTAGCAT-3' | (SEQ ID NO: 8384) |
| KRAS-938 Target: | 5'-ATTATTAGCATTTGTTTTAGC-3' | (SEQ ID NO: 8385) |
| KRAS-939 Target: | 5'-TTATTAGCATTTGTTTTAGCA-3' | (SEQ ID NO: 8386) |
| KRAS-940 Target: | 5'-TATTAGCATTTGTTTTAGCAT-3' | (SEQ ID NO: 8387) |
| KRAS-941 Target: | 5'-ATTAGCATTTGTTTTAGCATT-3' | (SEQ ID NO: 8388) |
| KRAS-942 Target: | 5'-TTAGCATTTGTTTTAGCATTA-3' | (SEQ ID NO: 8389) |
| KRAS-943 Target: | 5'-TAGCATTTGTTTTAGCATTAC-3' | (SEQ ID NO: 8390) |
| KRAS-944 Target: | 5'-AGCATTTGTTTTAGCATTACC-3' | (SEQ ID NO: 8391) |
| KRAS-945 Target: | 5'-GCATTTGTTTTAGCATTACCT-3' | (SEQ ID NO: 8392) |
| KRAS-946 Target: | 5'-CATTTGTTTTAGCATTACCTA-3' | (SEQ ID NO: 8393) |
| KRAS-1010 Target: | 5'-TGCTTATTTTAAAATGACAGT-3' | (SEQ ID NO: 8394) |
| KRAS-1012 Target: | 5'-CTTATTTTAAAATGACAGTGG-3' | (SEQ ID NO: 8395) |
| KRAS-1045 Target: | 5'-CCTCTAAGTGCCAGTATTCCC-3' | (SEQ ID NO: 8396) |
| KRAS-1197 Target: | 5'-AACAAATTAATGAAGCTTTTG-3' | (SEQ ID NO: 8397) |
| KRAS-1198 Target: | 5'-ACAAATTAATGAAGCTTTTGA-3' | (SEQ ID NO: 8398) |
| KRAS-1230 Target: | 5'-TCTGTGTTTTATCTAGTCACA-3' | (SEQ ID NO: 8399) |
| KRAS-1231 Target: | 5'-CTGTGTTTTATCTAGTCACAT-3' | (SEQ ID NO: 8400) |
| KRAS-1234 Target: | 5'-TGTTTTATCTAGTCACATAAA-3' | (SEQ ID NO: 8401) |
| KRAS-1249 Target: | 5'-CATAAATGGATTAATTACTAA-3' | (SEQ ID NO: 8402) |

TABLE 7 -continued

| DsiRNA Target Sequences (21 mers) | | |
|---|---|---|
| KRAS-1250 Target: | 5'-ATAAATGGATTAATTACTAAT-3' | (SEQ ID NO: 8403) |
| KRAS-1287 Target: | 5'-TAATTGGTTTTTACTGAAACA-3' | (SEQ ID NO: 8404) |
| KRAS-1527 Target: | 5'-GCCATTTCCTTTTCACATTAG-3' | (SEQ ID NO: 8405) |
| KRAS-1533 Target: | 5'-TCCTTTTCACATTAGATAAAT-3' | (SEQ ID NO: 8406) |
| KRAS-1540 Target: | 5'-CACATTAGATAAATTACTATA-3' | (SEQ ID NO: 8407) |
| KRAS-1541 Target: | 5'-ACATTAGATAAATTACTATAA-3' | (SEQ ID NO: 8408) |
| KRAS-1542 Target: | 5'-CATTAGATAAATTACTATAAA-3' | (SEQ ID NO: 8409) |
| KRAS-1583 Target: | 5'-GTTAAGGCAGACCCAGTATGA-3' | (SEQ ID NO: 8410) |
| KRAS-1584 Target: | 5'-TTAAGGCAGACCCAGTATGAA-3' | (SEQ ID NO: 8411) |
| KRAS-1585 Target: | 5'-TAAGGCAGACCCAGTATGAAA-3' | (SEQ ID NO: 8412) |
| KRAS-1586 Target: | 5'-AAGGCAGACCCAGTATGAAAT-3' | (SEQ ID NO: 8413) |
| KRAS-1597 Target: | 5'-AGTATGAAATGGGGATTATTA-3' | (SEQ ID NO: 8414) |
| KRAS-1606 Target: | 5'-TGGGGATTATTATAGCAACCA-3' | (SEQ ID NO: 8415) |
| KRAS-1630 Target: | 5'-TGGGGCTATATTTACATGCTA-3' | (SEQ ID NO: 8416) |
| KRAS-1631 Target: | 5'-GGGGCTATATTTACATGCTAC-3' | (SEQ ID NO: 8417) |
| KRAS-1632 Target: | 5'-GGGCTATATTTACATGCTACT-3' | (SEQ ID NO: 8418) |
| KRAS-1633 Target: | 5'-GGCTATATTTACATGCTACTA-3' | (SEQ ID NO: 8419) |
| KRAS-1634 Target: | 5'-GCTATATTTACATGCTACTAA-3' | (SEQ ID NO: 8420) |
| KRAS-1635 Target: | 5'-CTATATTTACATGCTACTAAA-3' | (SEQ ID NO: 8421) |
| KRAS-1636 Target: | 5'-TATATTTACATGCTACTAAAT-3' | (SEQ ID NO: 8422) |
| KRAS-1637 Target: | 5'-ATATTTACATGCTACTAAATT-3' | (SEQ ID NO: 8423) |
| KRAS-1638 Target: | 5'-TATTTACATGCTACTAAATTT-3' | (SEQ ID NO: 8424) |
| KRAS-1639 Target: | 5'-ATTTACATGCTACTAAATTTT-3' | (SEQ ID NO: 8425) |
| KRAS-1640 Target: | 5'-TTTACATGCTACTAAATTTTT-3' | (SEQ ID NO: 8426) |
| KRAS-1736 Target: | 5'-CTCTTTCATAGTATAACTTTA-3' | (SEQ ID NO: 8427) |
| KRAS-1741 Target: | 5'-TCATAGTATAACTTTAAATCT-3' | (SEQ ID NO: 8428) |
| KRAS-1742 Target: | 5'-CATAGTATAACTTTAAATCTT-3' | (SEQ ID NO: 8429) |
| KRAS-1753 Target: | 5'-TTTAAATCTTTTCTTCAACTT-3' | (SEQ ID NO: 8430) |
| KRAS-1754 Target: | 5'-TTAAATCTTTTCTTCAACTTG-3' | (SEQ ID NO: 8431) |
| KRAS-1769 Target: | 5'-AACTTGAGTCTTTGAAGATAG-3' | (SEQ ID NO: 8432) |
| KRAS-1771 Target: | 5'-CTTGAGTCTTTGAAGATAGTT-3' | (SEQ ID NO: 8433) |
| KRAS-1772 Target: | 5'-TTGAGTCTTTGAAGATAGTTT-3' | (SEQ ID NO: 8434) |
| KRAS-1783 Target: | 5'-AAGATAGTTTTAATTCTGCTT-3' | (SEQ ID NO: 8435) |
| KRAS-1784 Target: | 5'-AGATAGTTTTAATTCTGCTTG-3' | (SEQ ID NO: 8436) |
| KRAS-1785 Target: | 5'-GATAGTTTTAATTCTGCTTGT-3' | (SEQ ID NO: 8437) |
| KRAS-1799 Target: | 5'-TGCTTGTGACATTAAAAGATT-3' | (SEQ ID NO: 8438) |
| KRAS-2100 Target: | 5'-AATATTAACTCAAAAGTTGAG-3' | (SEQ ID NO: 8439) |
| KRAS-2134 Target: | 5'-GGTGTGCCAAGACATTAATTT-3' | (SEQ ID NO: 8440) |
| KRAS-2216 Target: | 5'-ACTGGTTAAATTAACATTGCA-3' | (SEQ ID NO: 8441) |

TABLE 7 -continued

| DsiRNA Target Sequences (21 mers) | | |
|---|---|---|
| KRAS-2217 Target: 5'-CTGGTTAAATTAACATTGCAT-3' | (SEQ ID NO: 8442) | |
| KRAS-2218 Target: 5'-TGGTTAAATTAACATTGCATA-3' | (SEQ ID NO: 8443) | |
| KRAS-2229 Target: 5'-ACATTGCATAAACACTTTTCA-3' | (SEQ ID NO: 8444) | |
| KRAS-2247 Target: 5'-TCAAGTCTGATCCATATTTAA-3' | (SEQ ID NO: 8445) | |
| KRAS-2326 Target: 5'-TTTAAAATAAATGAAGTGAGA-3' | (SEQ ID NO: 8446) | |
| KRAS-2327 Target: 5'-TTAAAATAAATGAAGTGAGAT-3' | (SEQ ID NO: 8447) | |
| KRAS-2547 Target: 5'-TCAAGCTCAGCACAATCTGTA-3' | (SEQ ID NO: 8448) | |
| KRAS-2548 Target: 5'-CAAGCTCAGCACAATCTGTAA-3' | (SEQ ID NO: 8449) | |
| KRAS-3741 Target: 5'-GCATAACTGTGATTCTTTTAG-3' | (SEQ ID NO: 8450) | |
| KRAS-3746 Target: 5'-ACTGTGATTCTTTTAGGACAA-3' | (SEQ ID NO: 8451) | |
| KRAS-3747 Target: 5'-CTGTGATTCTTTTAGGACAAT-3' | (SEQ ID NO: 8452) | |
| KRAS-3783 Target: 5'-GGTGTATGTCAGATATTCATA-3' | (SEQ ID NO: 8453) | |
| KRAS-3784 Target: 5'-GTGTATGTCAGATATTCATAT-3' | (SEQ ID NO: 8454) | |
| KRAS-3810 Target: 5'-CAAATGTGTAATATTCCAGTT-3' | (SEQ ID NO: 8455) | |
| KRAS-4396 Target: 5'-CACACTGCATAGGAATTTAGA-3' | (SEQ ID NO: 8456) | |
| KRAS-4447 Target: 5'-GTCACCATTGCACAATTTTGT-3' | (SEQ ID NO: 8457) | |
| KRAS-4448 Target: 5'-TCACCATTGCACAATTTTGTC-3' | (SEQ ID NO: 8458) | |
| KRAS-4449 Target: 5'-CACCATTGCACAATTTTGTCC-3' | (SEQ ID NO: 8459) | |
| KRAS-4450 Target: 5'-ACCATTGCACAATTTTGTCCT-3' | (SEQ ID NO: 8460) | |
| KRAS-4451 Target: 5'-CCATTGCACAATTTTGTCCTA-3' | (SEQ ID NO: 8461) | |
| KRAS-4452 Target: 5'-CATTGCACAATTTTGTCCTAA-3' | (SEQ ID NO: 8462) | |
| KRAS-4748 Target: 5'-GATAGCATGAATTCTGCATTG-3' | (SEQ ID NO: 8463) | |
| KRAS-4749 Target: 5'-ATAGCATGAATTCTGCATTGA-3' | (SEQ ID NO: 8464) | |
| KRAS-4878 Target: 5'-AGTTTGAAGTGCCTGTTTGGG-3' | (SEQ ID NO: 8465) | |
| KRAS-4879 Target: 5'-GTTTGAAGTGCCTGTTTGGGA-3' | (SEQ ID NO: 8466) | |
| KRAS-4880 Target: 5'-TTTGAAGTGCCTGTTTGGGAT-3' | (SEQ ID NO: 8467) | |
| KRAS-5073 Target: 5'-CCTTTGAGTGCCAATTTCTTA-3' | (SEQ ID NO: 8468) | |
| KRAS-5074 Target: 5'-CTTTGAGTGCCAATTTCTTAC-3' | (SEQ ID NO: 8469) | |
| KRAS-5075 Target: 5'-TTTGAGTGCCAATTTCTTACT-3' | (SEQ ID NO: 8470) | |
| KRAS-5076 Target: 5'-TTGAGTGCCAATTTCTTACTA-3' | (SEQ ID NO: 8471) | |
| KRAS-5077 Target: 5'-TGAGTGCCAATTTCTTACTAG-3' | (SEQ ID NO: 8472) | |
| KRAS-5078 Target: 5'-GAGTGCCAATTTCTTACTAGT-3' | (SEQ ID NO: 8473) | |
| KRAS-5128 Target: 5'-GAATGTATTTAACTATTTTT-3' | (SEQ ID NO: 8474) | |
| KRAS-5129 Target: 5'-AATGTATTTTAACTATTTTTG-3' | (SEQ ID NO: 8475) | |
| KRAS-5138 Target: 5'-TAACTATTTTGTATAGTGTA-3' | (SEQ ID NO: 8476) | |
| KRAS-5139 Target: 5'-AACTATTTTGTATAGTGTAA-3' | (SEQ ID NO: 8477) | |
| KRAS-5140 Target: 5'-ACTATTTTGTATAGTGTAAA-3' | (SEQ ID NO: 8478) | |
| KRAS-5141 Target: 5'-CTATTTTGTATAGTGTAAAC-3' | (SEQ ID NO: 8479) | |
| KRAS-5142 Target: 5'-TATTTTGTATAGTGTAAACT-3' | (SEQ ID NO: 8480) | |

TABLE 7 -continued

DsiRNA Target Sequences (21 mers)

| | | |
|---|---|---|
| KRAS-5143 Target: | 5'-ATTTTTGTATAGTGTAAACTG-3' | (SEQ ID NO: 8481) |
| KRAS-5163 Target: | 5'-GAAACATGCACATTTTGTACA-3' | (SEQ ID NO: 8482) |
| KRAS-5164 Target: | 5'-AAACATGCACATTTTGTACAT-3' | (SEQ ID NO: 8483) |
| KRAS-5167 Target: | 5'-CATGCACATTTTGTACATTGT-3' | (SEQ ID NO: 8484) |
| KRAS-5168 Target: | 5'-ATGCACATTTTGTACATTGTG-3' | (SEQ ID NO: 8485) |
| KRAS-5169 Target: | 5'-TGCACATTTTGTACATTGTGC-3' | (SEQ ID NO: 8486) |
| KRAS-5170 Target: | 5'-GCACATTTTGTACATTGTGCT-3' | (SEQ ID NO: 8487) |
| KRAS-5171 Target: | 5'-CACATTTTGTACATTGTGCTT-3' | (SEQ ID NO: 8488) |
| KRAS-5172 Target: | 5'-ACATTTTGTACATTGTGCTTT-3' | (SEQ ID NO: 8489) |
| KRAS-5173 Target: | 5'-CATTTTGTACATTGTGCTTTC-3' | (SEQ ID NO: 8490) |
| KRAS-5197 Target: | 5'-TGTGGGACATATGCAGTGTGA-3' | (SEQ ID NO: 8491) |
| KRAS-5198 Target: | 5'-GTGGGACATATGCAGTGTGAT-3' | (SEQ ID NO: 8492) |
| KRAS-5199 Target: | 5'-TGGGACATATGCAGTGTGATC-3' | (SEQ ID NO: 8493) |
| KRAS-5200 Target: | 5'-GGGACATATGCAGTGTGATCC-3' | (SEQ ID NO: 8494) |
| KRAS-5201 Target: | 5'-GGACATATGCAGTGTGATCCA-3' | (SEQ ID NO: 8495) |
| KRAS-5202 Target: | 5'-GACATATGCAGTGTGATCCAG-3' | (SEQ ID NO: 8496) |
| KRAS-5203 Target: | 5'-ACATATGCAGTGTGATCCAGT-3' | (SEQ ID NO: 8497) |
| KRAS-5204 Target: | 5'-CATATGCAGTGTGATCCAGTT-3' | (SEQ ID NO: 8498) |
| KRAS-5205 Target: | 5'-ATATGCAGTGTGATCCAGTTG-3' | (SEQ ID NO: 8499) |
| KRAS-5209 Target: | 5'-GCAGTGTGATCCAGTTGTTTT-3' | (SEQ ID NO: 8500) |
| KRAS-5210 Target: | 5'-CAGTGTGATCCAGTTGTTTTC-3' | (SEQ ID NO: 8501) |
| KRAS-5211 Target: | 5'-AGTGTGATCCAGTTGTTTTCC-3' | (SEQ ID NO: 8502) |
| KRAS-5212 Target: | 5'-GTGTGATCCAGTTGTTTTCCA-3' | (SEQ ID NO: 8503) |
| KRAS-5213 Target: | 5'-TGTGATCCAGTTGTTTTCCAT-3' | (SEQ ID NO: 8504) |
| KRAS-5214 Target: | 5'-GTGATCCAGTTGTTTTCCATC-3' | (SEQ ID NO: 8505) |
| KRAS-5234 Target: | 5'-CATTTGGTTGCGCTGACCTAG-3' | (SEQ ID NO: 8506) |
| KRAS-5235 Target: | 5'-ATTTGGTTGCGCTGACCTAGG-3' | (SEQ ID NO: 8507) |
| KRAS-5252 Target: | 5'-TAGGAATGTTGGTCATATCAA-3' | (SEQ ID NO: 8508) |
| KRAS-5253 Target: | 5'-AGGAATGTTGGTCATATCAAA-3' | (SEQ ID NO: 8509) |
| KRAS-5254 Target: | 5'-GGAATGTTGGTCATATCAAAC-3' | (SEQ ID NO: 8510) |
| KRAS-5255 Target: | 5'-GAATGTTGGTCATATCAAACA-3' | (SEQ ID NO: 8511) |
| KRAS-5256 Target: | 5'-AATGTTGGTCATATCAAACAT-3' | (SEQ ID NO: 8512) |
| KRAS-5257 Target: | 5'-ATGTTGGTCATATCAAACATT-3' | (SEQ ID NO: 8513) |
| KRAS-5258 Target: | 5'-TGTTGGTCATATCAAACATTA-3' | (SEQ ID NO: 8514) |
| KRAS-5259 Target: | 5'-GTTGGTCATATCAAACATTAA-3' | (SEQ ID NO: 8515) |
| KRAS-5260 Target: | 5'-TTGGTCATATCAAACATTAAA-3' | (SEQ ID NO: 8516) |
| KRAS-5299 Target: | 5'-TGAAATTAACTTTTAAATGTT-3' | (SEQ ID NO: 8517) |
| KRAS-5300 Target: | 5'-GAAATTAACTTTTAAATGTTT-3' | (SEQ ID NO: 8518) |
| KRAS-5304 Target: | 5'-TTAACTTTTAAATGTTTATAG-3' | (SEQ ID NO: 8519) |

TABLE 7 -continued

DsiRNA Target Sequences (21 mers)

| | | | |
|---|---|---|---|
| KRAS-5305 Target: | 5'-TAACTTTTAAATGTTTATAGG-3' | (SEQ ID NO: | 8520) |
| KRAS-5306 Target: | 5'-AACTTTTAAATGTTTATAGGA-3' | (SEQ ID NO: | 8521) |
| KRAS-5307 Target: | 5'-ACTTTTAAATGTTTATAGGAG-3' | (SEQ ID NO: | 8522) |
| KRAS-5308 Target: | 5'-CTTTTAAATGTTTATAGGAGT-3' | (SEQ ID NO: | 8523) |
| KRAS-5309 Target: | 5'-TTTTAAATGTTTATAGGAGTA-3' | (SEQ ID NO: | 8524) |
| KRAS-5347 Target: | 5'-TAAAATTTGTAATATTTTTGT-3' | (SEQ ID NO: | 8525) |
| KRAS-5348 Target: | 5'-AAAATTTGTAATATTTTTGTC-3' | (SEQ ID NO: | 8526) |
| KRAS-5349 Target: | 5'-AAATTTGTAATATTTTTGTCA-3' | (SEQ ID NO: | 8527) |
| KRAS-5350 Target: | 5'-AATTTGTAATATTTTTGTCAT-3' | (SEQ ID NO: | 8528) |
| KRAS-5351 Target: | 5'-ATTTGTAATATTTTTGTCATG-3' | (SEQ ID NO: | 8529) |
| KRAS-5352 Target: | 5'-TTTGTAATATTTTTGTCATGA-3' | (SEQ ID NO: | 8530) |
| KRAS-5353 Target: | 5'-TTGTAATATTTTTGTCATGAA-3' | (SEQ ID NO: | 8531) |
| KRAS-5354 Target: | 5'-TGTAATATTTTTGTCATGAAC-3' | (SEQ ID NO: | 8532) |
| KRAS-5389 Target: | 5'-TTATTGTAATGTAATAAAAAT-3' | (SEQ ID NO: | 8533) |
| KRAS-5390 Target: | 5'-TATTGTAATGTAATAAAAATA-3' | (SEQ ID NO: | 8534) |
| KRAS-5391 Target: | 5'-ATTGTAATGTAATAAAAATAG-3' | (SEQ ID NO: | 8535) |
| KRAS-5392 Target: | 5'-TTGTAATGTAATAAAAATAGT-3' | (SEQ ID NO: | 8536) |
| KRAS-5393 Target: | 5'-TGTAATGTAATAAAAATAGTT-3' | (SEQ ID NO: | 8537) |

Within Tables 2-7 above, underlined residues indicate 2'-O-methyl residues, UPPER CASE indicates ribonucleotides, lower case denotes deoxyribonucleotides, and in Table 2, "P-" indicates a 5'-terminal phosphate group. The above DsiRNA agents of Tables 3-6 are 25/27mer agents possessing a blunt end. The structures and/or modification patterning of the agents of Tables 3-6 can be readily adapted to the above generic sequence structures, e.g., the 3' overhang of the second strand can be extended or contracted, 2'-O-methylation of the second strand can be expanded towards the 5' end of the second strand, optionally at alternating sites, etc. Such further modifications are optional, as 25/27mer DsiRNAs with such modifications can also be readily designed from the above DsiRNA agents and are also expected to be functional inhibitors of KRAS expression.

In certain embodiments, the DsiRNA agents of the invention require, e.g., at least 19, at least 20, at least 21, at least 22, at least 23, at least 24, at least 25 or at least 26 residues of the first strand to be complementary to corresponding residues of the second strand. In certain related embodiments, these first strand residues complementary to corresponding residues of the second strand are optionally consecutive residues.

As used herein "DsiRNAmm" refers to a DisRNA having a "mismatch tolerant region" containing one, two, three or four mismatched base pairs of the duplex formed by the sense and antisense strands of the DsiRNA, where such mismatches are positioned within the DsiRNA at a location(s) lying between (and thus not including) the two terminal base pairs of either end of the DsiRNA. The mismatched base pairs are located within a "mismatch-tolerant region" which is defined herein with respect to the location of the projected Ago2 cut site of the corresponding target nucleic acid. The mismatch tolerant region is located "upstream of" the projected Ago2 cut site of the target strand. "Upstream" in this context will be understood as the 5'-most portion of the DsiRNAmm duplex, where 5' refers to the orientation of the sense strand of the DsiRNA duplex. Therefore, the mismatch tolerant region is upstream of the base on the sense (passenger) strand that corresponds to the projected Ago2 cut site of the target nucleic acid (see FIG. 1); alternatively, when referring to the antisense (guide) strand of the DsiRNAmm, the mismatch tolerant region can also be described as positioned downstream of the base that is complementary to the projected Ago2 cut site of the target nucleic acid, that is, the 3'-most portion of the antisense strand of the DsiRNAmm (where position 1 of the antisense strand is the 5' terminal nucleotide of the antisense strand, see FIG. 1).

In one embodiment, for example with numbering as depicted in FIG. 1, the mismatch tolerant region is positioned between and including base pairs 3-9 when numbered from the nucleotide starting at the 5' end of the sense strand of the duplex. Therefore, a DsiRNAmm of the invention possesses a single mismatched base pair at any one of positions 3, 4, 5, 6, 7, 8 or 9 of the sense strand of a right-hand extended DsiRNA (where position 1 is the 5' terminal nucleotide of the sense strand and position 9 is the nucleotide residue of the sense strand that is immediately 5' of the projected Ago2 cut site of the target KRAS RNA sequence corresponding to the sense strand sequence). In certain embodiments, for a DsiRNAmm that possesses a mismatched base pair nucleotide at any of positions 3, 4, 5, 6, 7, 8 or 9 of the sense strand, the corresponding mismatched base pair nucleotide of the antisense strand not only forms a mismatched base pair with the DsiRNAmm sense strand sequence, but also forms a mismatched base pair with a DsiRNAmm target KRAS RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target KRAS RNA sequence). In alternative embodiments, the mismatch base pair nucleotide of the antisense strand of a DsiRNAmm only form a mismatched base pair with a corresponding nucleotide of the sense strand sequence of the DsiRNAmm, yet base pairs with its corresponding target KRAS RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target KRAS RNA sequence).

A DsiRNAmm of the invention that possesses a single mismatched base pair within the mismatch-tolerant region (mismatch region) as described above (e.g., a DsiRNAmm harboring a mismatched nucleotide residue at any one of positions 3, 4, 5, 6, 7, 8 or 9 of the sense strand) can further include one, two or even three additional mismatched base pairs. In preferred embodiments, these one, two or three additional mismatched base pairs of the DsiRNAmm occur at position(s) 3, 4, 5, 6, 7, 8 and/or 9 of the sense strand (and at corresponding residues of the antisense strand). In one embodiment where one additional mismatched base pair is present within a DsiRNAmm, the two mismatched base pairs of the sense strand can occur, e.g., at nucleotides of both position 4 and position 6 of the sense strand (with mismatch also occurring at corresponding nucleotide residues of the antisense strand).

In DsiRNAmm agents possessing two mismatched base pairs, mismatches can occur consecutively (e.g., at consecutive positions along the sense strand nucleotide sequence). Alternatively, nucleotides of the sense strand that form mismatched base pairs with the antisense strand sequence can be interspersed by nucleotides that base pair with the antisense strand sequence (e.g., for a DsiRNAmm possessing mismatched nucleotides at positions 3 and 6, but not at positions 4 and 5, the mismatched residues of sense strand positions 3 and 6 are interspersed by two nucleotides that form matched base pairs with corresponding residues of the antisense strand). For example, two residues of the sense strand (located within the mismatch-tolerant region of the sense strand) that form mismatched base pairs with the corresponding antisense strand sequence can occur with zero, one, two, three, four or five matched base pairs located between these mismatched base pairs.

For certain DsiRNAmm agents possessing three mismatched base pairs, mismatches can occur consecutively (e.g., in a triplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiRNAmm possessing mismatched nucleotides at positions 3, 4 and 8, but not at positions 5, 6 and 7, the mismatched residues of sense strand positions 3 and 4 are adjacent to one another, while the mismatched residues of sense strand positions 4 and 8 are interspersed by three nucleotides that form matched base pairs with corresponding residues of the antisense strand). For example, three residues of the sense strand (located within the mismatch-tolerant region of the sense strand) that form mismatched base pairs with the corresponding antisense strand sequence can occur with zero, one, two, three or four matched base pairs located between any two of these mismatched base pairs.

For certain DsiRNAmm agents possessing four mismatched base pairs, mismatches can occur consecutively (e.g., in a quadruplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiRNAmm possessing mismatched nucleotides at positions 3, 5, 7 and 8, but not at positions 4 and 6, the mismatched residues of sense strand positions 7 and 8 are adjacent to one another, while the mismatched residues of sense strand positions 3 and 5 are interspersed by one nucleotide that forms a matched base pair with the corresponding residue of the antisense strand—similarly, the mismatched residues of sense strand positions 5 and 7 are also interspersed by one nucleotide that forms a matched base pair with the corresponding residue of the antisense strand). For example, four residues of the sense strand (located within the mismatch-tolerant region of the sense strand) that form mismatched base pairs with the corresponding antisense strand sequence can occur with zero, one, two or three matched base pairs located between any two of these mismatched base pairs.

In another embodiment, for example with numbering also as depicted in FIG. 1, a DsiRNAmm of the invention comprises a mismatch tolerant region which possesses a single mismatched base pair nucleotide at any one of positions 17, 18, 19, 20, 21, 22 or 23 of the antisense strand of the DsiRNA (where position 1 is the 5' terminal nucleotide of the antisense strand and position 17 is the nucleotide residue of the antisense strand that is immediately 3' (downstream) in the antisense strand of the projected Agog cut site of the target KRAS RNA sequence sufficiently complementary to the antisense strand sequence). In certain embodiments, for a DsiRNAmm that possesses a mismatched base pair nucleotide at any of positions 17, 18, 19, 20, 21, 22 or 23 of the antisense strand with respect to the sense strand of the DsiRNAmm, the mismatched base pair nucleotide of the antisense strand not only forms a mismatched base pair with the DsiRNAmm sense strand sequence, but also forms a mismatched base pair with a DsiRNAmm target KRAS RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target KRAS RNA sequence). In alternative embodiments, the mismatch base pair nucleotide of the antisense strand of a DsiRNAmm only forms a mismatched base pair with a corresponding nucleotide of the sense strand sequence of the DsiRNAmm, yet base pairs with its corresponding target KRAS RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target KRAS RNA sequence).

A DsiRNAmm of the invention that possesses a single mismatched base pair within the mismatch-tolerant region as described above (e.g., a DsiRNAmm harboring a mismatched nucleotide residue at positions 17, 18, 19, 20, 21, 22 or 23 of the antisense strand) can further include one, two or even three additional mismatched base pairs. In preferred embodiments, these one, two or three additional mismatched base pairs of the DsiRNAmm occur at position(s) 17, 18, 19, 20, 21, 22 and/or 23 of the antisense strand (and at corresponding residues of the sense strand). In one embodiment where one additional mismatched base pair is present within a DsiR- NAmm, the two mismatched base pairs of the antisense strand can occur, e.g., at nucleotides of both position 18 and position 20 of the antisense strand (with mismatch also occurring at corresponding nucleotide residues of the sense strand).

In DsiRNAmm agents possessing two mismatched base pairs, mismatches can occur consecutively (e.g., at consecutive positions along the antisense strand nucleotide sequence). Alternatively, nucleotides of the antisense strand that form mismatched base pairs with the sense strand sequence can be interspersed by nucleotides that base pair with the sense strand sequence (e.g., for a DsiRNAmm possessing mismatched nucleotides at positions 17 and 20, but not at positions 18 and 19, the mismatched residues of antisense strand positions 17 and 20 are interspersed by two nucleotides that form matched base pairs with corresponding residues of the sense strand). For example, two residues of the antisense strand (located within the mismatch-tolerant region of the sense strand) that form mismatched base pairs with the corresponding sense strand sequence can occur with zero, one, two, three, four, five, six or seven matched base pairs located between these mismatched base pairs.

For certain DsiRNAmm agents possessing three mismatched base pairs, mismatches can occur consecutively (e.g., in a triplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 17, 18 and 22, but not at positions 19, 20 and 21, the mismatched residues of antisense strand positions 17 and 18 are adjacent to one another, while the mismatched residues of antisense strand positions 18 and 122 are interspersed by three nucleotides that form matched base pairs with corresponding residues of the sense strand). For example, three residues of the antisense strand (located within the mismatch-tolerant region of the antisense strand) that form mismatched base pairs with the corresponding sense strand sequence can occur with zero, one, two, three, four, five or six matched base pairs located between any two of these mismatched base pairs.

For certain DsiRNAmm agents possessing four mismatched base pairs, mismatches can occur consecutively (e.g., in a quadruplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 18, 20, 22 and 23, but not at positions 19 and 21, the mismatched residues of antisense strand positions 22 and 23 are adjacent to one another, while the mismatched residues of antisense strand positions 18 and 20 are interspersed by one nucleotide that forms a matched base pair with the corresponding residue of the sense strand—similarly, the mismatched residues of antisense strand positions 20 and 22 are also interspersed by one nucleotide that forms a matched base pair with the corresponding residue of the sense strand). For example, four residues of the antisense strand (located within the mismatch-tolerant region of the antisense strand) that form mismatched base pairs with the corresponding sense strand sequence can occur with zero, one, two, three, four or five matched base pairs located between any two of these mismatched base pairs.

For reasons of clarity, the location(s) of mismatched nucleotide residues within the above DsiRNAmm agents are numbered in reference to the 5' terminal residue of either sense or antisense strands of the DsiRNAmm. The numbering of positions located within the mismatch-tolerant region (mismatch region) of the antisense strand can shift with variations in the proximity of the 5' terminus of the sense or antisense strand to the projected Ago2 cleavage site. Thus, the location(s) of preferred mismatch sites within either antisense strand or sense strand can also be identified as the permissible proximity of such mismatches to the projected Ago2 cut site. Accordingly, in one preferred embodiment, the position of a mismatch nucleotide of the sense strand of a DsiRNAmm is the nucleotide residue of the sense strand that is located immediately 5' (upstream) of the projected Ago2 cleavage site of the corresponding target KRAS RNA sequence. In other preferred embodiments, a mismatch nucleotide of the sense strand of a DsiRNAmm is positioned at the nucleotide residue of the sense strand that is located two nucleotides 5' (upstream) of the projected Ago2 cleavage site, three nucleotides 5' (upstream) of the projected Ago2 cleavage site, four nucleotides 5' (upstream) of the projected Ago2 cleavage site, five nucleotides 5' (upstream) of the projected Ago2 cleavage site, six nucleotides 5' (upstream) of the projected Ago2 cleavage site, seven nucleotides 5' (upstream) of the projected Ago2 cleavage site, eight nucleotides 5' (upstream) of the projected Ago2 cleavage site, or nine nucleotides 5' (upstream) of the projected Ago2 cleavage site.

Exemplary single mismatch-containing 25/27mer DsiRNAs (DsiRNAmm) include the following structures (such mismatch-containing structures may also be incorporated into other exemplary DsiRNA structures shown herein).

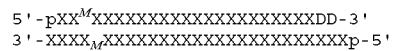
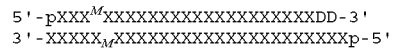
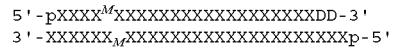
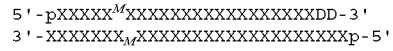
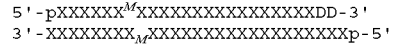
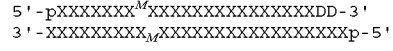
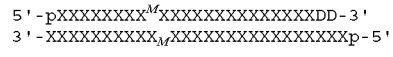

wherein "X"=RNA, "D"=DNA, "p"=a phosphate group, "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown above, can also be used in the above DsiRNAmm agents. For the above mismatch structures, the top strand is the sense strand, and the bottom strand is the antisense strand.

In certain embodiments, a DsiRNA of the invention can contain mismatches that exist in reference to the target KRAS RNA sequence yet do not necessarily exist as mismatched base pairs within the two strands of the DsiRNA—thus, a DsiRNA can possess perfect complementarity between first and second strands of a DsiRNA, yet still possess mismatched residues in reference to a target KRAS RNA (which, in certain embodiments, may be advantageous in promoting efficacy and/or potency and/or duration of effect). In certain embodiments, where mismatches occur between antisense strand and target KRAS RNA sequence, the position of a mismatch is located within the antisense strand at a position(s) that corresponds to a sequence of the sense strand located 5' of the projected Ago2 cut site of the target region—e.g., antisense strand residue(s) positioned within the antisense strand to the 3' of the antisense residue which is complementary to the projected Ago2 cut site of the target sequence.

Exemplary 25/27mer DsiRNAs that harbor a single mismatched residue in reference to target sequences include the following preferred structures.

```
Target RNA Sequence:
5'-. . . XXAXXXXXXXXXXXXXXXX . . .-3'

DsiRNAmm Sense Strand:
5'-pXXBXXXXXXXXXXXXXXXXXXXXDD-3'

DsiRNAmm Antisense Strand:
3'-XXXXEXXXXXXXXXXXXXXXXXXXXXXXp-5'

Target RNA Sequence:
5'-. . . XXXAXXXXXXXXXXXXXXX . . .-3'

DsiRNAmm Sense Strand:
5'-pXXXBXXXXXXXXXXXXXXXXXXDD-3'

DsiRNAmm Antisense Strand:
3'-XXXXXEXXXXXXXXXXXXXXXXXXXXXXp-5'

Target RNA Sequence:
5'-. . . XXXXAXXXXXXXXXXXXXX . . .-3'

DsiRNAmm Sense Strand:
5'-pXXXXBXXXXXXXXXXXXXXXXXDD-3'

DsiRNAmm Antisense Strand:
3'-XXXXXXEXXXXXXXXXXXXXXXXXXXXXp-5'

Target RNA Sequence:
5'-. . . XXXXXAXXXXXXXXXXXXX . . .-3'

DsiRNAmm Sense Strand:
5'-pXXXXXBXXXXXXXXXXXXXXXXDD-3'

DsiRNAmm Antisense Strand:
3'-XXXXXXXEXXXXXXXXXXXXXXXXXXXXp-5'

Target RNA Sequence:
5'-. . . XXXXXXAXXXXXXXXXXXX . . .-3'

DsiRNAmm Sense Strand:
5'-pXXXXXXBXXXXXXXXXXXXXXXDD-3'

DsiRNAmm Antisense Strand:
3'-XXXXXXXXEXXXXXXXXXXXXXXXXXXXXp-5'

Target RNA Sequence:
5'-. . . XXXXXXXAXXXXXXXXXXX . . .-3'

DsiRNAmm Sense Strand:
5'-pXXXXXXXBXXXXXXXXXXXXXXDD-3'

DsiRNAmm Antisense Strand:
3'-XXXXXXXXXEXXXXXXXXXXXXXXXXXXXXp-5'

Target RNA Sequence:
5'-. . . XXXXXXXXAXXXXXXXXXX . . .-3'

DsiRNAmm Sense Strand:
5'-pXXXXXXXXBXXXXXXXXXXXXXDD-3'

DsiRNAmm Antisense Strand:
3'-XXXXXXXXXXEXXXXXXXXXXXXXXXXXXXXp-5'
``` wherein "X"=RNA, "D"=DNA, "p"=a phosphate group, "E"=Nucleic acid residues (RNA, DNA or non-natural or modified nucleic acids) that do not base pair (hydrogen bond) with corresponding "A" RNA residues of otherwise complementary (target) strand when strands are annealed, yet optionally do base pair with corresponding "B" residues ("B" residues are also RNA, DNA or non-natural or modified nucleic acids). Any of the residues of such agents can optionally be 2'-O-methyl RNA monomers—alternating positioning of 2'-O-methyl RNA monomers that commences from the 3'-terminal residue of the bottom (second) strand, as shown above, can also be used in the above DsiRNA agents.

In addition to the above-exemplified structures, DsiRNAs of the invention can also possess one, two or three additional residues that form further mismatches with the target KRAS RNA sequence. Such mismatches can be consecutive, or can be interspersed by nucleotides that form matched base pairs with the target KRAS RNA sequence. Where interspersed by nucleotides that form matched base pairs, mismatched residues can be spaced apart from each other within a single strand at an interval of one, two, three, four, five, six, seven or even eight base paired nucleotides between such mismatch-forming residues.

As for the above-described DsiRNAmm agents, a preferred location within DsiRNAs for antisense strand nucleotides that form mismatched base pairs with target KRAS RNA sequence (yet may or may not form mismatches with corresponding sense strand nucleotides) is within the antisense strand region that is located 3' (downstream) of the antisense strand sequence which is complementary to the projected Ago2 cut site of the DsiRNA (e.g., in FIG. 1, the region of the antisense strand which is 3' of the projected Ago2 cut site is preferred for mismatch-forming residues and happens to be located at positions 17-23 of the antisense strand for the 25/27mer agent shown in FIG. 1). Thus, in one preferred embodiment, the position of a mismatch nucleotide (in relation to the target KRAS RNA sequence) of the antisense strand of a DsiRNAmm is the nucleotide residue of the antisense strand that is located immediately 3' (downstream) within the antisense strand sequence of the projected Ago2 cleavage site of the corresponding target KRAS RNA sequence. In other preferred embodiments, a mismatch nucleotide of the antisense strand of a DsiRNAmm (in relation to the target KRAS RNA sequence) is positioned at the nucleotide residue of the antisense strand that is located two nucleotides 3' (downstream) of the corresponding projected Ago2 cleavage site, three nucleotides 3' (downstream) of the corresponding projected Ago2 cleavage site, four nucleotides 3' (downstream) of the corresponding projected Ago2 cleavage site, five nucleotides 3' (downstream) of the corresponding projected Ago2 cleavage site, six nucleotides 3' (downstream) of the projected Ago2 cleavage site, seven nucleotides 3' (downstream) of the projected Ago2 cleavage site, eight nucleotides 3' (downstream) of the projected Ago2 cleavage site, or nine nucleotides 3' (downstream) of the projected Ago2 cleavage site.

In DsiRNA agents possessing two mismatch-forming nucleotides of the antisense strand (where mismatch-forming nucleotides are mismatch forming in relation to target KRAS RNA sequence), mismatches can occur consecutively (e.g., at consecutive positions along the antisense strand nucleotide sequence). Alternatively, nucleotides of the antisense strand that form mismatched base pairs with the target KRAS RNA sequence can be interspersed by nucleotides that base pair with the target KRAS RNA sequence (e.g., for a DsiRNA possessing mismatch-forming nucleotides at positions 17 and 20 (starting from the 5' terminus (position 1) of the antisense strand of the 25/27mer agent shown in FIG. 1), but not at positions 18 and 19, the mismatched residues of sense strand positions 17 and 20 are interspersed by two nucleotides that form matched base pairs with corresponding residues of the target KRAS RNA sequence). For example, two residues of the antisense strand (located within the mismatch-tolerant region of the antisense strand) that form mismatched base pairs with the corresponding target KRAS RNA sequence can occur with zero, one, two, three, four or five matched base pairs (with respect to target KRAS RNA sequence) located between these mismatch-forming base pairs.

For certain DsiRNAs possessing three mismatch-forming base pairs (mismatch-forming with respect to target KRAS RNA sequence), mismatch-forming nucleotides can occur consecutively (e.g., in a triplet along the antisense strand nucleotide sequence). Alternatively, nucleotides of the antisense strand that form mismatched base pairs with the target KRAS RNA sequence can be interspersed by nucleotides that form matched base pairs with the target KRAS RNA sequence (e.g., for a DsiRNA possessing mismatched nucleotides at positions 17, 18 and 22, but not at positions 19, 20 and 21, the mismatch-forming residues of antisense strand positions 17 and 18 are adjacent to one another, while the mismatch-forming residues of antisense strand positions 18 and 22 are interspersed by three nucleotides that form matched base pairs with corresponding residues of the target KRAS RNA). For example, three residues of the antisense strand (located within the mismatch-tolerant region of the antisense strand) that form mismatched base pairs with the corresponding target KRAS RNA sequence can occur with zero, one, two, three or four matched base pairs located between any two of these mismatch-forming base pairs.

For certain DsiRNAs possessing four mismatch-forming base pairs (mismatch-forming with respect to target KRAS RNA sequence), mismatch-forming nucleotides can occur consecutively (e.g., in a quadruplet along the sense strand nucleotide sequence). Alternatively, nucleotides of the antisense strand that form mismatched base pairs with the target KRAS RNA sequence can be interspersed by nucleotides that form matched base pairs with the target KRAS RNA sequence (e.g., for a DsiRNA possessing mismatch-forming nucleotides at positions 17, 19, 21 and 22, but not at positions 18 and 20, the mismatch-forming residues of antisense strand positions 21 and 22 are adjacent to one another, while the mismatch-forming residues of antisense strand positions 17 and 19 are interspersed by one nucleotide that forms a matched base pair with the corresponding residue of the target KRAS RNA sequence—similarly, the mismatch-forming residues of antisense strand positions 19 and 21 are also interspersed by one nucleotide that forms a matched base pair with the corresponding residue of the target KRAS RNA sequence). For example, four residues of the antisense strand (located within the mismatch-tolerant region of the antisense strand) that form mismatched base pairs with the corresponding target KRAS RNA sequence can occur with zero, one, two or three matched base pairs located between any two of these mismatch-forming base pairs.

The above DsiRNAmm and other DsiRNA structures are described in order to exemplify certain structures of DsiRNAmm and DsiRNA agents. Design of the above DsiRNAmm and DsiRNA structures can be adapted to generate, e.g., DsiRNAmm forms of other DsiRNA structures shown infra. As exemplified above, DsiRNAs can also be designed that possess single mismatches (or two, three or four mismatches) between the antisense strand of the DsiRNA and a target sequence, yet optionally can retain perfect complementarity between sense and antisense strand sequences of a DsiRNA.

It is further noted that the DsiRNA agents exemplified infra can also possess insertion/deletion (in/del) structures within their double-stranded and/or target KRAS RNA-aligned structures. Accordingly, the DsiRNAs of the invention can be designed to possess in/del variations in, e.g., antisense strand sequence as compared to target KRAS RNA sequence and/or antisense strand sequence as compared to sense strand sequence, with preferred location(s) for placement of such in/del nucleotides corresponding to those locations described above for positioning of mismatched and/or mismatch-forming base pairs.

It is also noted that the DsiRNAs of the instant invention can tolerate mismatches within the 3'-terminal region of the sense strand/5'-terminal region of the antisense strand, as this region is modeled to be processed by Dicer and liberated from the guide strand sequence that loads into RISC. Exemplary DsiRNA structures of the invention that harbor such mismatches include the following:

```
Target RNA Sequence:
5'-. . . XXXXXXXXXXXXXXXXXXXXHXXX . . .-3'

DsiRNA Sense Strand:
5'-pXXXXXXXXXXXXXXXXXXXXXIXDD-3'

DsiRNA Antisense Strand:
3'-XXXXXXXXXXXXXXXXXXXXXJXXp-5'

Target RNA Sequence:
5'-. . . XXXXXXXXXXXXXXXXXXXXHXX. . .-3'

DsiRNA Sense Strand:
5'-pXXXXXXXXXXXXXXXXXXXXXIDD-3'

DsiRNA Antisense Strand:
3'-XXXXXXXXXXXXXXXXXXXXXJXXp-5'

Target RNA Sequence:
5'-. . . XXXXXXXXXXXXXXXXXXXXHX . . .-3'

DsiRNA Sense Strand:
5'-pXXXXXXXXXXXXXXXXXXXXXID-3'

DsiRNA Antisense Strand:
3'-XXXXXXXXXXXXXXXXXXXXXJXp-5'

Target RNA Sequence:
5'-. . . XXXXXXXXXXXXXXXXXXXXXH . . .-3'

DsiRNA Sense Strand:
5'-pXXXXXXXXXXXXXXXXXXXXXDI-3'

DsiRNA Antisense Strand:
3'-XXXXXXXXXXXXXXXXXXXXXJp-5'
``` wherein "X"=RNA, "D"=DNA, "p"=a phosphate group, "I" and "J"=Nucleic acid residues (RNA, DNA or non-natural or modified nucleic acids) that do not base pair (hydrogen bond) with one another, yet optionally "J" is complementary to target RNA sequence nucleotide "H". Any of the residues of such agents can optionally be 2'-O-methyl RNA monomers—alternating positioning of 2'-O-methyl RNA monomers that commences from the 3'-terminal residue of the bottom (second) strand, as shown above—or any of the above-described methylation patterns—can also be used in the above DsiRNA agents. The above mismatches can also be combined within the DsiRNAs of the instant invention.

In the below structures, such mismatches are introduced within the asymmetric KRAS-420 DsiRNA (newly-introduced mismatch residues are italicized):
KRAS-420 25/27mer DsiRNA, mismatch position=22 of sense strand (from 5'-terminus)

5'-GUAUUUGCCAUAAAUAAUACU$^C$Aat-3' (SEQ ID NO: 5136)

3'-CACAUAAACGGUAUUUAUUAUGA$_U$UUA-5' (SEQ ID NO: 26)

Optionally, the mismatched "C" residue of position 22 of the sense strand is alternatively "G" or "U",
KRAS-420 25/27mer DsiRNA, mismatch position=23 of sense strand 5'-GUAUUUGCCAUAAAUAAUACUA$^C$at-3' (SEQ ID NO: 5137)

3'-CACAUAAACGGUAUUUAUUAUGAU$_U$UA-5' (SEQ ID NO: 26)

Optionally, the mismatched "C" residue of position 23 of the sense strand is alternatively "G" or "U".
KRAS-420 25/27mer DsiRNA, mismatch position=24 of sense strand 5'-GUAUUUGCCAUAAAUAAUACUAA$^c$t-3' (SEQ ID NO: 5138)

3'-CACAUAAACGGUAUUUAUUAUGAUU$_U$A-5' (SEQ ID NO: 26)

Optionally, the mismatched "c" residue of position 24 of the sense strand is alternatively "g" or "t".
KRAS-420 25/27mer DsiRNA, mismatch position=25 of sense strand 5'-GUAUUUGCCAUAAAUAAUACUAAa$^g$-3' (SEQ ID NO: 5139)

3'-CACAUAAACGGUAUUUAUUAUGAUUU$_A$-5' (SEQ ID NO: 26)

Optionally, the mismatched "g" residue of position 25 of the sense strand is alternatively "c" or "a".
KRAS-420 25/27mer DsiRNA, mismatch position=1 of antisense strand 5'-GUAUUUGCCAUAAAUAAUACUAAa$^t$-3' (SEQ ID NO: 105)

3'-CACAUAAACGGUAUUUAUUAUGAUUU$_C$-5' (SEQ ID NO: 5140)

Optionally, the mismatched "C" residue of position 1 of the antisense strand is alternatively "G" or "U".
KRAS-420 25/27mer DsiRNA, mismatch position=2 of antisense strand 5'-GUAUUUGCCAUAAAUAAUACUAA$^a$t-3' (SEQ ID NO: 105)

3'-CACAUAAACGGUAUUUAUUAUGAUU$_C$A-5' (SEQ ID NO: 5141)

Optionally, the mismatched "C" residue of position 2 of the antisense strand is alternatively "G" or "A".
KRAS-420 25/27mer DsiRNA, mismatch position=3 of antisense strand 5'-GUAUUUGCCAUAAAUAAUACUA$^A$at-3' (SEQ ID NO: 105)

3'-CACAUAAACGGUAUUUAUUAUGAU$_G$UA-5'. (SEQ ID NO: 5142)

Optionally, the mismatched "G" residue of position 3 of the antisense strand is alternatively "A" or "C"
KRAS-420 25/27mer DsiRNA, mismatch position=4 of antisense strand 5'-GUAUUUGCCAUAAAUAAUACU$^A$Aat-3' (SEQ ID NO: 105)

3'-CACAUAAACGGUAUUUAUUAUGA$_G$UUA-5' (SEQ ID NO: 5143)

Optionally, the mismatched "G" residue of position 4 of the antisense strand is alternatively "A" or "C".

As noted above, introduction of such mismatches can be performed upon any of the DsiRNAs described herein.

The mismatches of such DsiRNA structures can be combined to produce a DsiRNA possessing, e.g., two, three or even four mismatches within the 3'-terminal four nucleotides of the sense strand/5'-terminal four nucleotides of the antisense strand.

Indeed, in view of the flexibility of sequences which can be incorporated into DsiRNAs at the 3'-terminal residues of the sense strand/5'-terminal residues of the antisense strand, in certain embodiments, the sequence requirements of an asymmetric DsiRNA of the instant invention can be represented as the following (minimalist) structure (shown for an exemplary KRAS-420 DsiRNA sequence):

5'-GUAUUUGCCAUAAAUAAUACUXXX[X]$_n$-3'  (SEQ ID NO: 6839)

3'-CACAUAAACGGUAUUUAUUAUXXXXX[X]$_n$-5'  (SEQ ID NO: 6840)

where n=1 to 5, 1 to 10, 1 to 20, 1 to 30, 1 to 50, or 1 to 80 or more.
KRAS-420 Target:

(SEQ ID NO: 6841)
5'-GTGTATTTGCCATAAATAATAXXXXXX-3'

The KRAS target sight may also be a site which is targeted by one or more of several oligonucleotides whose complementary target sites overlap with a stated target site. For example, for the exemplary KRAS-420 DsiRNA, it is noted that certain DsiRNAs targeting overlapping and only slightly offset KRAS sequences can exhibit activity levels similar to that of KRAS-420 (specifically, see KRAS-415, KRAS-417 and KRAS-418 DsiRNAs of FIG. 10, and KRAS-422, KRAS-423, KRAS-424, KRAS-425 and KRAS-426 DsiRNAs of Table 9 and FIGS. 12 and 13. Thus, in certain embodiments, a designated target sequence region can be effectively targeted by a series of DsiRNAs possessing largely overlapping sequences. (E.g., if considering DsiRNAs surrounding the KRAS-420 site, a more encompassing KRAS target sequence might be recited as, e.g., 5'-TCTTTGTGTATTTGCCATAAATAATACTAAATCA-3' (SEQ ID NO: 6842), wherein any given DsiRNA (e.g., a DsiRNA selected from KRAS-415, KRAS-417, KRAS-418, KRAS-420, KRAS-422, KRAS-423, KRAS-424, KRAS-425 and KRAS-426) only targets a sub-sequence within such a sequence region, yet the entire sequence can be considered a viable target for such a series of DsiRNAs).

Additionally and/or alternatively, mismatches within the 3'-terminal four nucleotides of the sense strand/5'-terminal four nucleotides of the antisense strand can be combined with mismatches positioned at other mismatch-tolerant positions, as described above.

In view of the present identification of the above-described Dicer substrate agents (DsiRNAs) as inhibitors of KRAS levels via targeting of specific KRAS sequences, it is also recognized that DsiRNAs having structures similar to those described herein can also be synthesized which target other sequences within the KRAS sequence of SEQ ID NO: 1 or SEQ ID NO: 3, or within variants thereof (e.g., target sequences possessing 80% identity, 90% identity, 95% identity, 96% identity, 97% identity, 98% identity, 99% or more identity to a sequence of SEQ ID NO: 1 and/or SEQ ID NO: 3).

Anti-KRAS DsiRNA Design/Synthesis

It has been found empirically that longer dsRNA species of from 25 to 35 nucleotides (DsiRNAs) and especially from 25 to 30 nucleotides give unexpectedly effective results in terms of potency and duration of action, as compared to 19-23mer siRNA agents. Without wishing to be bound by the underlying theory of the dsRNA processing mechanism, it is thought that the longer dsRNA species serve as a substrate for the Dicer enzyme in the cytoplasm of a cell. In addition to cleaving the dsRNA of the invention into shorter segments, Dicer is thought to facilitate the incorporation of a single-stranded cleavage product derived from the cleaved dsRNA into the RISC complex that is responsible for the destruction of the cytoplasmic RNA (e.g., KRAS RNA) of or derived from the target gene, KRAS (or other gene associated with a KRAS-associated disease or disorder). Prior studies (Rossi et al., U.S. Patent Application No. 2007/0265220) have shown that the cleavability of a dsRNA species (specifically, a DsiRNA agent) by Dicer corresponds with increased potency and duration of action of the dsRNA species.

Certain preferred anti-KRAS DsiRNA agents were selected from a pre-screened population. Design of DsiRNAs can optionally involve use of predictive scoring algorithms that perform in silico assessments of the projected activity/ efficacy of a number of possible DsiRNA agents spanning a region of sequence. Information regarding the design of such scoring algorithms can be found, e.g., in Gong et al. (*BMC Bioinformatics* 2006, 7:516), though a more recent "v3" algorithm represents a theoretically improved algorithm relative to siRNA scoring algorithms previously available in the art. (The "v3" scoring algorithm is a machine learning algorithm that is not reliant upon any biases in human sequence. In addition, the "v3" algorithm derives from a data set that is approximately three-fold larger than that from which an older "v2" algorithm such as that described in Gong et al. derives.)

The first and second oligonucleotides of the DsiRNA agents of the instant invention are not required to be completely complementary. In fact, in one embodiment, the 3'-terminus of the sense strand contains one or more mismatches. In one aspect, two mismatches are incorporated at the 3' terminus of the sense strand. In another embodiment, the DsiRNA of the invention is a double stranded RNA molecule containing two RNA oligonucleotides each of which is 27 nucleotides in length and, when annealed to each other, have blunt ends and a two nucleotide mismatch on the 3'-terminus of the sense strand (the 5'-terminus of the antisense strand). The use of mismatches or decreased thermodynamic stability (specifically at the 3'-sense/5'-antisense position) has been proposed to facilitate or favor entry of the antisense strand into RISC (Schwarz et al., 2003, *Cell* 115: 199-208; Khvorova et al., 2003, *Cell* 115: 209-216), presumably by affecting some rate-limiting unwinding steps that occur with entry of the siRNA into RISC. Thus, terminal base composition has been included in design algorithms for selecting active 21mer siRNA duplexes (Ui-Tei et al., 2004, *Nucleic Acids Res* 32: 936-948; Reynolds et al., 2004, *Nat Biotechnol* 22: 326-330). With Dicer cleavage of the dsRNA of this embodiment, the small end-terminal sequence which contains the mismatches will either be left unpaired with the antisense strand (become part of a 3'-overhang) or be cleaved entirely off the final 21-mer siRNA. These "mismatches", therefore, do not persist as mismatches in the final RNA component of RISC. The finding that base mismatches or destabilization of segments at the 3'-end of the sense strand of Dicer substrate improved the potency of synthetic duplexes in RNAi, presumably by facilitating processing by Dicer, was a surprising finding of past works describing the design and use of 25-30mer dsRNAs (also termed "DsiRNAs" herein; Rossi et al., U.S. Patent Application Nos. 2005/0277610, 2005/0244858 and 2007/0265220).

Modification of Anti-KRAS DsiRNAs

One major factor that inhibits the effect of double stranded RNAs ("dsRNAs") is the degradation of dsRNAs (e.g., siRNAs and DsiRNAs) by nucleases. A 3'-exonuclease is the primary nuclease activity present in serum and modification of the 3'-ends of antisense DNA oligonucleotides is crucial to prevent degradation (Eder et al., 1991, *Antisense Res Dev*, 1: 141-151). An RNase-T family nuclease has been identified called ERI-1 which has 3' to 5' exonuclease activity that is involved in regulation and degradation of siRNAs (Kennedy et al., 2004, *Nature* 427: 645-649; Hong et al., 2005, *Biochem J*, 390: 675-679). This gene is also known as Thex1 (NM_02067) in mice or THEX1 (NM_153332) in humans and is involved in degradation of histone mRNA; it also mediates degradation of 3'-overhangs in siRNAs, but does not degrade duplex RNA (Yang et al., 2006, *J Biol Chem*, 281: 30447-30454). It is therefore reasonable to expect that 3'-end-stabilization of dsRNAs, including the DsiRNAs of the instant invention, will improve stability.

XRN1 (NM_019001) is a 5' to 3' exonuclease that resides in P-bodies and has been implicated in degradation of mRNA targeted by miRNA (Rehwinkel et al., 2005, *RNA* 11: 1640-1647) and may also be responsible for completing degradation initiated by internal cleavage as directed by a siRNA. XRN2 (NM_012255) is a distinct 5' to 3' exonuclease that is involved in nuclear RNA processing.

RNase A is a major endonuclease activity in mammals that degrades RNAs. It is specific for ssRNA and cleaves at the 3'-end of pyrimidine bases. siRNA degradation products consistent with RNase A cleavage can be detected by mass spectrometry after incubation in serum (Turner et al., 2007, *Mol Biosyst* 3: 43-50). The 3'-overhangs enhance the susceptibility of siRNAs to RNase degradation. Depletion of RNase A from serum reduces degradation of siRNAs; this degradation does show some sequence preference and is worse for sequences having poly A/U sequence on the ends (Haupenthal et al., 2006 *Biochem Pharmacol* 71: 702-710). This suggests the possibility that lower stability regions of the duplex may "breathe" and offer transient single-stranded species available for degradation by RNase A. RNase A inhibitors can be added to serum and improve siRNA longevity and potency (Haupenthal et al., 2007, *Int J. Cancer* 121: 206-210).

In 21 mers, phosphorothioate or boranophosphate modifications directly stabilize the internucleoside phosphate linkage. Boranophosphate modified RNAs are highly nuclease resistant, potent as silencing agents, and are relatively non-toxic. Boranophosphate modified RNAs cannot be manufactured using standard chemical synthesis methods and instead are made by in vitro transcription (NT) (Hall et al., 2004, *Nucleic Acids Res* 32: 5991-6000; Hall et al., 2006, *Nucleic Acids Res* 34: 2773-2781). Phosphorothioate (PS) modifications can be easily placed in the RNA duplex at any desired position and can be made using standard chemical synthesis methods. The PS modification shows dose-dependent toxicity, so most investigators—have recommended limited incorporation in siRNAs, favoring the 3'-ends where protection from nucleases is most important (Harborth et al., 2003, *Antisense Nucleic Acid Drug Dev* 13: 83-105; Chiu and Rana, 2003, *Mol Cell* 10: 549-561; Braasch et al., 2003, *Biochemistry* 42: 7967-7975; Amarzguioui et al., 2003, *Nucleic Acids Research* 31: 589-595). More extensive PS modification can be compatible with potent RNAi activity; however, use of sugar modifications (such as 2'-O-methyl RNA) may be superior (Choung et al., 2006, *Biochem Biophys Res Commun* 342: 919-927).

A variety of substitutions can be placed at the 2'-position of the ribose which generally increases duplex stability ($T_m$) and can greatly improve nuclease resistance. 2'-O-methyl RNA is a naturally occurring modification found in mammalian ribosomal RNAs and transfer RNAs. 2'-O-methyl modification in siRNAs is known, but the precise position of modified bases within the duplex is important to retain potency and complete substitution of 2'-O-methyl RNA for RNA will inactivate the siRNA. For example, a pattern that employs alternating 2'-O-methyl bases can have potency equivalent to unmodified RNA and is quite stable in serum (Choung et al., 2006, *Biochem Biophys Res Commun* 342: 919-927; Czauderna et al., 2003, *Nucleic Acids Research* 31: 2705-2716).

The 2'-fluoro (2'-F) modification is also compatible with dsRNA (e.g., siRNA and DsiRNA) function; it is most commonly placed at pyrimidine sites (due to reagent cost and availability) and can be combined with 2'-O-methyl modification at purine positions; 2'-F purines are available and can also be used. Heavily modified duplexes of this kind can be potent triggers of RNAi in vitro (Allerson et al., 2005, *J Med Chem* 48: 901-904; Prakash et al., 2005, *J Med Chem* 48: 4247-4253; Kraynack and Baker, 2006, *RNA* 12: 163-176) and can improve performance and extend duration of action when used in vivo (Morrissey et al., 2005, *Hepatology* 41: 1349-1356; Morrissey et al., 2005, *Nat Biotechnol* 23: 1002-1007). A highly potent, nuclease stable, blunt 19mer duplex containing alternative 2'-F and 2'-O-Me bases is taught by Allerson. In this design, alternating 2'-O-Me residues are positioned in an identical pattern to that employed by Czauderna, however the remaining RNA residues are converted to 2'-F modified bases. A highly potent, nuclease resistant siRNA employed by Morrissey employed a highly potent, nuclease resistant siRNA in vivo. In addition to 2'-O-Me RNA and 2'-F RNA, this duplex includes DNA, RNA, inverted abasic residues, and a 3'-terminal PS internucleoside linkage. While extensive modification has certain benefits, more limited modification of the duplex can also improve in vivo performance and is both simpler and less costly to manufacture. Soutschek et al. (2004, *Nature* 432: 173-178) employed a duplex in vivo and was mostly RNA with two 2'-O-Me RNA bases and limited 3'-terminal PS internucleoside linkages.

Locked nucleic acids (LNAs) are a different class of 2'-modification that can be used to stabilize dsRNA (e.g., siRNA and DsiRNA). Patterns of LNA incorporation that retain potency are more restricted than 2'-O-methyl or 2'-F bases, so limited modification is preferred (Braasch et al., 2003, *Biochemistry* 42: 7967-7975; Grunweller et al., 2003, *Nucleic Acids Res* 31: 3185-3193; Elmen et al., 2005, *Nucleic Acids Res* 33: 439-447). Even with limited incorporation, the use of LNA modifications can improve dsRNA performance in vivo and may also alter or improve off target effect profiles (Mook et al., 2007, *Mol Cancer Ther* 6: 833-843).

Synthetic nucleic acids introduced into cells or live animals can be recognized as "foreign" and trigger an immune response. Immune stimulation constitutes a major class of off-target effects which can dramatically change experimental results and even lead to cell death. The innate immune system includes a collection of receptor molecules that specifically interact with DNA and RNA that mediate these responses, some of which are located in the cytoplasm and some of which reside in endosomes (Marques and Williams, 2005, *Nat Biotechnol* 23: 1399-1405; Schlee et al., 2006, *Mol Ther* 14: 463-470). Delivery of siRNAs by cationic lipids or liposomes exposes the siRNA to both cytoplasmic and endosomal compartments, maximizing the risk for triggering a type 1 interferon (IFN) response both in vitro and in vivo (Morrissey et al., 2005, *Nat Biotechnol* 23: 1002-1007; Sioud and Sorensen, 2003, *Biochem Biophys Res Commun* 312: 1220-1225; Sioud, 2005, *J Mol Biol* 348: 1079-1090; Ma et al., 2005, *Biochem Biophys Res Commun* 330: 755-759). RNAs transcribed within the cell are less immunogenic (Robbins et al., 2006, *Nat Biotechnol* 24: 566-571) and synthetic RNAs that are immunogenic when delivered using lipid-based methods can evade immune stimulation when introduced unto cells by mechanical means, even in vivo (Heidel et al., 2004, *Nat Biotechnol* 22: 1579-1582). However, lipid based delivery methods are convenient, effective, and widely used. Some general strategy to prevent immune responses is needed, especially for in vivo application where all cell types are present and the risk of generating an immune response is highest. Use of chemically modified RNAs may solve most or even all of these problems.

In certain embodiments, modifications can be included in the anti-KRAS DsiRNA agents of the present invention so long as the modification does not prevent the DsiRNA agent from possessing KRAS inhibitory activity. In one embodiment, one or more modifications are made that enhance Dicer processing of the DsiRNA agent (an assay for determining Dicer processing of a DsiRNA is described supra). In a second embodiment, one or more modifications are made that result in more effective KRAS inhibition (as described herein, KRAS inhibition/KRAS inhibitory activity of a DsiRNA can be assayed via art-recognized methods for determining RNA levels, or for determining Kras polypeptide levels, should such levels be assessed in lieu of or in addition to assessment of, e.g., KRAS mRNA levels). In a third embodiment, one or more modifications are made that support greater KRAS inhibitory activity (means of determining KRAS inhibitory activity are described supra). In a fourth embodiment, one or more modifications are made that result in greater potency of KRAS inhibitory activity per each DsiRNA agent molecule to be delivered to the cell (potency of KRAS inhibitory activity is described supra). Modifications can be incorporated in the 3'-terminal region, the 5'-terminal region, in both the 3'-terminal and 5'-terminal region or in some instances in various positions within the sequence. With the restrictions noted above in mind, numbers and combinations of modifications can be incorporated into the DsiRNA agent. Where multiple modifications are present, they may be the same or different. Modifications to bases, sugar moieties, the phosphate backbone, and their combinations are contemplated. Either 5'-terminus can be phosphorylated.

Examples of modifications contemplated for the phosphate backbone include phosphonates, including methylphosphonate, phosphorothioate, and phosphotriester modifications such as alkylphosphotriesters, and the like. Examples of modifications contemplated for the sugar moiety include 2'-alkyl pyrimidine, such as 2'-O-methyl, 2'-fluoro, amino, and deoxy modifications and the like (see, e.g., Amarzguioui et al., 2003, *Nucleic Acids Research* 31: 589-595). Examples of modifications contemplated for the base groups include abasic sugars, 2-O-alkyl modified pyrimidines, 4-thiouracil, 5-bromouracil, 5-iodouracil, and 5-(3-aminoallyl)-uracil and the like. Locked nucleic acids, or LNA's, could also be incorporated. Many other modifications are known and can be used so long as the above criteria are satisfied. Examples of modifications are also disclosed in U.S. Pat. Nos. 5,684,143, 5,858,988 and 6,291,438 and in U.S. published patent application No. 2004/0203145 A1. Other modifications are disclosed in Herdewijn (2000, *Antisense Nucleic Acid Drug Dev* 10: 297-310), Eckstein (2000, *Antisense Nucleic Acid Drug Dev* 10: 117-21), Rusckowski et al. (2000, *Antisense Nucleic Acid Drug Dev* 10: 333-345), Stein et al. (2001, *Antisense Nucleic Acid Drug Dev* 11: 317-25); Vorobjev et al. (2001, *Antisense Nucleic Acid Drug Dev* 11: 77-85).

One or more modifications contemplated can be incorporated into either strand. The placement of the modifications in the DsiRNA agent can greatly affect the characteristics of the DsiRNA agent, including conferring greater potency and stability, reducing toxicity, enhance Dicer processing, and minimizing an immune response. In one embodiment, the antisense strand or the sense strand or both strands have one or more 2'-O-methyl modified nucleotides. In another embodiment, the antisense strand contains 2'-O-methyl modified nucleotides. In another embodiment, the antisense stand contains a 3' overhang that is comprised of 2'-O-methyl modified nucleotides. The antisense strand could also include additional 2'-O-methyl modified nucleotides.

In certain embodiments of the present invention, the anti-KRAS DsiRNA agent has one or more of the following properties: (i) the DsiRNA agent is asymmetric, e.g., has a 3' overhang on the antisense strand and (ii) the DsiRNA agent has a modified 3' end on the sense strand to direct orientation of Dicer binding and processing of the dsRNA to an active siRNA. According to this embodiment, the longest strand in the dsRNA comprises 25-35 nucleotides (e.g., 25, 26, 27, 28, 29, 30, 31, 32, 33, 34 or 35 nucleotides). In certain such embodiments, the DsiRNA agent is asymmetric such that the sense strand comprises 25-34 nucleotides and the 3' end of the sense strand forms a blunt end with the 5' end of the antisense strand while the antisense strand comprises 26-35 nucleotides and forms an overhang on the 3' end of the antisense strand. In one embodiment, the DsiRNA agent is asymmetric such that the sense strand comprises 25-28 nucleotides and the antisense strand comprises 25-30 nucleotides. Thus, the resulting dsRNA has an overhang on the 3' end of the antisense strand. The overhang is 1-4 nucleotides, for example 2 nucleotides. The sense strand may also have a 5' phosphate.

In other embodiments, the sense strand of the DsiRNA agent is modified for Dicer processing by suitable modifiers located at the 3' end of the sense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotides modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the sense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the DsiRNA agent to direct the orientation of Dicer processing of the antisense strand. In a further embodiment of the present invention, two terminal DNA bases are substituted for two ribonucleotides on the 3'-end of the sense strand forming a blunt end of the duplex on the 3' end of the sense strand and the 5' end of the antisense strand, and a two-nucleotide RNA overhang is located on the 3'-end of the antisense strand. This is an asymmetric composition with DNA on the blunt end and RNA bases on the overhanging end.

The sense and antisense strands of a DsiRNA agent of the instant invention anneal under biological conditions, such as the conditions found in the cytoplasm of a cell. In addition, a region of one of the sequences, particularly of the antisense strand, of the DsiRNA agent has a sequence length of at least 19 nucleotides, wherein these nucleotides are in the 21-nucleotide region adjacent to the 3' end of the antisense strand and are sufficiently complementary to a nucleotide sequence of the RNA produced from the target gene.

The DsiRNA agent can also have one or more of the following additional properties: (a) the antisense strand has a right shift from the typical 21mer (e.g., the DsiRNA comprises a length of antisense strand nucleotides that extends to the 5' of a projected Dicer cleavage site within the DsiRNA, with such antisense strand nucleotides base paired with corresponding nucleotides of the sense strand extending 3' of a projected Dicer cleavage site in the sense strand), (b) the strands may not be completely complementary, i.e., the strands may contain simple mismatched base pairs (in certain embodiments, the DsiRNAs of the invention possess 1, 2, 3, 4 or even 5 or more mismatched base pairs, provided that KRAS inhibitory activity of the DsiRNA possessing mismatched base pairs is retained at sufficient levels (e.g., retains at least 50% KRAS inhibitory activity or more, at least 60% KRAS inhibitory activity or more, at least 70% KRAS inhibitory activity or more, at least 80% KRAS inhibitory activity or more, at least 90% KRAS inhibitory activity or more or at least 95% KRAS inhibitory activity or more as compared to a corresponding DsiRNA not possessing mismatched base pairs. In certain embodiments, mismatched base pairs exist between the antisense and sense strands of a DsiRNA. In some embodiments, mismatched base pairs exist (or are predicted to exist) between the antisense strand and the target RNA. In certain embodiments, the presence of a mismatched base pair(s) between an antisense strand residue and a corresponding residue within the target RNA that is located 3' in the target RNA sequence of a projected Ago2 cleavage site retains and may even enhance KRAS inhibitory activity of a DsiRNA of the invention) and (c) base modifications such as locked nucleic acid(s) may be included in the 5' end of the sense strand. A "typical" 21 mer siRNA is designed using conventional techniques. In one technique, a variety of sites are commonly tested in parallel or pools containing several distinct siRNA duplexes specific to the same target with the hope that one of the reagents will be effective (Ji et al., 2003, *FEBS Lett* 552: 247-252). Other techniques use design rules and algorithms to increase the likelihood of obtaining active RNAi effector molecules (Schwarz et al., 2003, *Cell* 115:

199-208; Khvorova et al., 2003, *Cell* 115: 209-216; Ui-Tei et al., 2004, *Nucleic Acids Res* 32: 936-948; Reynolds et al., 2004, *Nat Biotechnol* 22: 326-330; Krol et al., 2004, *J Biol Chem* 279: 42230-42239; Yuan et al., 2004, *Nucl Acids Res* 32(Webserver issue):W 130-134; Boese et al., 2005, *Methods Enzymol* 392: 73-96). High throughput selection of siRNA has also been developed (U.S. published patent application No. 2005/0042641 A1). Potential target sites can also be analyzed by secondary structure predictions (Heale et al., 2005, *Nucleic Acids Res* 33(3): e30). This 21mer is then used to design a right shift to include 3-9 additional nucleotides on the 5' end of the 21mer. The sequence of these additional nucleotides is not restricted. In one embodiment, the added ribonucleotides are based on the sequence of the target gene. Even in this embodiment, full complementarity between the target sequence and the antisense siRNA is not required.

The first and second oligonucleotides of a DsiRNA agent of the instant invention are not required to be completely complementary. They only need to be sufficiently complementary to anneal under biological conditions and to provide a substrate for Dicer that produces a siRNA sufficiently complementary to the target sequence. Locked nucleic acids, or LNA's, are well known to a skilled artisan (Elmen et al., 2005, *Nucleic Acids Res* 33: 439-447; Kurreck et al., 2002, *Nucleic Acids Res* 30: 1911-1918; Crinelli et al., 2002, *Nucleic Acids Res* 30: 2435-2443; Braasch and Corey, 2001, *Chem Biol* 8: 1-7; Bondensgaard et al., 2000, *Chemistry* 6: 2687-2695; Wahlestedt et al., 2000, *Proc Natl Acad Sci USA* 97: 5633-5638). In one embodiment, an LNA is incorporated at the 5' terminus of the sense strand. In another embodiment, an LNA is incorporated at the 5' terminus of the sense strand in duplexes designed to include a 3' overhang on the antisense strand.

In certain embodiments, the DsiRNA agent of the instant invention has an asymmetric structure, with the sense strand having a 25-base pair length, and the antisense strand having a 27-base pair length with a 2 base 3'-overhang. In other embodiments, this DsiRNA agent having an asymmetric structure further contains 2 deoxynucleotides at the 3' end of the sense strand in place of two of the ribonucleotides.

Certain DsiRNA agent compositions containing two separate oligonucleotides can be linked by a third structure. The third structure will not block Dicer activity on the DsiRNA agent and will not interfere with the directed destruction of the RNA transcribed from the target gene. In one embodiment, the third structure may be a chemical linking group. Many suitable chemical linking groups are known in the art and can be used. Alternatively, the third structure may be an oligonucleotide that links the two oligonucleotides of the DsiRNA agent in a manner such that a hairpin structure is produced upon annealing of the two oligonucleotides making up the dsRNA composition. The hairpin structure will not block Dicer activity on the DsiRNA agent and will not interfere with the directed destruction of the KRAS RNA.

In certain embodiments, the anti-KRAS DsiRNA agent of the invention has several properties which enhance its processing by Dicer. According to such embodiments; the DsiRNA agent has a length sufficient such that it is processed by Dicer to produce an siRNA and at least one of the following properties: (i) the DsiRNA agent is asymmetric, e.g., has a 3' overhang on the sense strand and (ii) the DsiRNA agent has a modified 3' end on the antisense strand to direct orientation of Dicer binding and processing of the dsRNA to an active siRNA. According to these embodiments, the longest strand in the DsiRNA agent comprises 25-30 nucleotides. In one embodiment, the sense strand comprises 25-30 nucleotides and the antisense strand comprises 25-28 nucleotides.

Thus, the resulting dsRNA has an overhang on the 3' end of the sense strand. The overhang is 1-4 nucleotides, such as 2 nucleotides. The antisense strand may also have a 5' phosphate.

In certain embodiments, the sense strand of a DsiRNA agent is modified for Dicer processing by suitable modifiers located at the 3' end of the sense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the sense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the sense strand in place of two ribonucleotides forming a blunt end of the duplex on the 5' end of the antisense strand and the 3' end of the sense strand, and a two-nucleotide RNA overhang is located on the 3'-end of the antisense strand. This is an asymmetric composition with DNA on the blunt end and RNA bases on the overhanging end.

In certain other embodiments, the antisense strand of a DsiRNA agent is modified for Dicer processing by suitable modifiers located at the 3' end of the antisense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the antisense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the antisense strand in place of two ribonucleotides forming a blunt end of the duplex on the 5' end of the sense strand and the 3' end of the antisense strand, and a two-nucleotide RNA overhang is located on the 3'-end of the sense strand. This is also an asymmetric composition with DNA on the blunt end and RNA bases on the overhanging end.

The sense and antisense strands anneal under biological conditions, such as the conditions found in the cytoplasm of a cell. In addition, a region of one of the sequences, particularly of the antisense strand, of the dsRNA has a sequence length of at least 19 nucleotides, wherein these nucleotides are adjacent to the 3' end of antisense strand and are sufficiently complementary to a nucleotide sequence of the target KRAS RNA.

Additionally, the DsiRNA agent structure can be optimized to ensure that the oligonucleotide segment generated from Dicer's cleavage will be the portion of the oligonucleotide that is most effective in inhibiting gene expression. For example, in one embodiment of the invention, a 27-bp oligonucleotide of the DsiRNA agent structure is synthesized wherein the anticipated 21 to 22-bp segment that will inhibit gene expression is located on the 3'-end of the antisense strand. The remaining bases located on the 5'-end of the antisense strand will be cleaved by Dicer and will be discarded. This cleaved portion can be homologous (i.e., based on the sequence of the target sequence) or non-homologous and added to extend the nucleic acid strand.

US 2007/0265220 discloses that 27mer DsiRNAs show improved stability in serum over comparable 21mer siRNA compositions, even absent chemical modification. Modifications of DsiRNA agents, such as inclusion of 2'-O-methyl RNA in the antisense strand, in patterns such as detailed above, when coupled with addition of a 5' Phosphate, can improve stability of DsiRNA agents. Addition of 5'-phosphate to all strands in synthetic RNA duplexes may be an inexpensive and physiological method to confer some limited degree of nuclease stability. The chemical modification patterns of the DsiRNA agents of the instant invention are designed to enhance the efficacy of such agents. Accordingly, such modifications are designed to avoid reducing potency of DsiRNA agents; to avoid interfering with Dicer processing of DsiRNA agents; to improve stability in biological fluids (reduce nuclease sensitivity) of DsiRNA agents; or to block or evade detection by the innate immune system. Such modifications are also designed to avoid being toxic and to avoid increasing the cost or impact the ease of manufacturing the instant DsiRNA agents of the invention.

KRAS Biology and Biochemistry

Transformation is a cumulative process whereby normal control of cell growth and differentiation is interrupted, usually through the accumulation of mutations affecting the expression of genes that regulate cell growth and differentiation.

The platelet derived growth factor (PDGF) system has served as a prototype for identification of substrates of the receptor tyrosine kinases. Certain enzymes become activated by the PDGF receptor kinase, including phospholipase C and phosphatidylinositol 3' kinase, Ras guanosine triphosphate (GTPase) activating protein (GAP) and src-like tyrosine kinases. GAP regulates the function of the Ras protein by stimulating the GTPase activity of the 21 kD Ras protein. Barbacid, 56 *Ann. Rev. Biochem.* 779, 1987. Microinjection of oncogenically activated Ras into NIH 3T3 cells has been shown to induce DNA synthesis. Mutations that cause oncogenic activation of Ras lead to accumulation of Ras bound to GTP, the active form of the molecule. These mutations block the ability of GAP to convert Ras to the inactive form. Mutations that impair the interactions of Ras with GAP also block the biological function of Ras.

While a number of Ras alleles exist (N-Ras, KRAS, H-Ras) which have been implicated in carcinogenesis, the type most often associated with colon and pancreatic carcinomas is KRAS. Nucleic acid molecules which are targeted to certain regions of the KRAS allelic mRNAs may also prove inhibitory to the function of the other allelic mRNAs of the N-Ras and H-Ras genes.

The use of DsiRNA agents targeting KRAS therefore provides a class of novel therapeutic agents that can be used in the treatment, alleviation, or prevention of cancer and/or proliferative diseases, conditions, or disorders, alone or in combination with other therapies.

Known human KRAS gene and polypeptide sequences include the following:
Wild-type KRAS sequence (SEQ ID NO: 1; K-Ras4A—transcript variant a; GenBank Accession No. NM_033360.2):

```
GGCCGCGGCGGCGGAGGCAGCAGCGGCGGCGGCAGTGGCGGCGGCGAAGG

TGGCGGCGGCTCGGCCAGTACTCCCGGCCCCCGCCATTTCGGACTGGGAG

CGAGCGCGGCGCAGGCACTGAAGGCGGCGGCGGGGCCAGAGGCTCAGCGG

CTCCCAGGTGCGGGAGAGAGGCCTGCTGAAAATGACTGAATATAAACTTG

TGGTAGTTGGAGCTGGTGGCGTAGGCAAGAGTGCCTTGACGATACAGCTA

ATTCAGAATCATTTTGTGGACGAATATGATCCAACAATAGAGGATTCCTA

CAGGAAGCAAGTAGTAATTGATGGAGAAACCTGTCTCTTGGATATTCTCG

ACACAGCAGGTCAAGAGGAGTACAGTGCAATGAGGGACCAGTACATGAGG

ACTGGGGAGGGCTTTCTTTGTGTATTTGCCATAAATAATACTAAATCATT

TGAAGATATTCACCATTATAGAGAACAAATTAAAAGAGTTAAGGACTCTG

AAGATGTACCTATGGTCCTAGTAGGAAATAAATGTGATTTGCCTTCTAGA

ACAGTAGACACAAAACAGGCTCAGGACTTAGCAAGAAGTTATGGAATTCC

TTTTATTGAAACATCAGCAAAGACAAGACAGAGAGTGGAGGATGCTTTTT

ATACATTGGTGAGGGAGATCCGACAATACAGATTGAAAAAAATCAGCAAA

GAAGAAAAGACTCCTGGCTGTGTGAAAATTAAAAAATGCATTATAATGTA

ATCTGGGTGTTGATGATGCCTTCTATACATTAGTTCGAGAAATTCGAAAA

CATAAAGAAAGATGAGCAAAGATGGTAAAAAGAAGAAAAAGAAGTCAAA

GACAAAGTGTGTAATTATGTAAATACAATTTGTACTTTTTTCTTAAGGCA

TACTAGTACAAGTGGTAATTTTTGTACATTACACTAAATTATTTAGCATT

TGTTTTAGCATTACCTAATTTTTTTCCTGCTCCATGCAGACTGTTAGCTT

TTACCTTAAATGCTTATTTTAAAATGACAGTGGAAGTTTTTTTTTCCTCT

AAGTGCCAGTATTCCCAGAGTTTTGGTTTTTGAACTAGCAATGCCTGTGA

AAAAGAAACTGAATACCTAAGATTTCTGTCTTGGGGTTTTTGGTGCATGC

AGTTGATTACTTCTTATTTTTCTTACCAATTGTGAATGTTGGTGTGAAAC

AAATTAATGAAGCTTTTGAATCATCCCTATTCTGTGTTTTATCTAGTCAC

ATAAATGGATTAATTACTAATTTCAGTTGAGACCTTCTAATTGGTTTTTA

CTGAAACATTGAGGGAACACAAATTTATGGGCTTCCTGATGATGATTCTT

CTAGGCATCATGTCCTATAGTTTGTCATCCCTGATGAATGTAAAGTTACA

CTGTTCACAAAGGTTTTGTCTCCTTTCCACTGCTATTAGTCATGGTCACT
```

-continued
CTCCCCAAAATATTATATTTTTCTATAAAAAGAAAAAAATGGAAAAAAA
TTACAAGGCAATGGAAACTATTATAAGGCCATTTCCTTTTCACATTAGAT
AAATTACTATAAAGACTCCTAATAGCTTTTCCTGTTAAGGCAACCCAGTG
ATGAAATGGGGATTATTATAGCAACCATTTTGGGGCTATATTTTACATGC
TACTAAATTTTTATAATAATTGAAAAGATTTTAACAAGTATAAAAAATTC
TCATAGGAATTAAATGTAGTCTCCCTGTGTCAGACTGCTCTTTCATAGTA
TAACTTTAAATCTTTTCTTCAACTTGAGTCTTTGAAGATAGTTTTAATTC
TGCTTGTGACATTAAAAGATTATTTGGGCCAGTTATAGCTTATTAGGTGT
TGAAGAGACCAAGGTTGCAAGGCCAGGCCCTGTGTGAACCTTTGAGCTTT
CATAGAGAGTTTCACAGCATGGACTGTGTCCCCACGGTCATCCAGTGTTG
TCATGCATTGGTTAGTCAAAATGGGGAGGGACTAGGGCAGTTTGGATAGC
TCAACAAGATACAATCTCACTCTGTGGTGGTCCTGCTGACAAATCAAGAG
CATTGCTTTTGTTTCTTAAGAAAACAAACTCTTTTTTAAAAATTACTTTT
AAATATTAACTCAAAAGTTGAGATTTTGGGGTGGTGGTGTGCCAAGACAT
TAATTTTTTTTTTTAAACAATGAAGTGAAAAAGTTTTACAATCTCTAGGT
TTGGCTAGTTCTCTTAACACTGGTTAAATTAACATTGCATAAACACTTTT
CAAGTCTGATCCATATTTAATAATGCTTTAAAATAAAAATAAAAACAATC
CTTTTGATAAATTTAAAATGTTACTTATTTTAAAATAAATGAAGTGAGAT
GGCATGGTGAGGTGAAAGTATCACTGGACTAGGAAGAAGGTGACTTAGGT
TCTAGATAGGTGTCTTTTAGGACTCTGATTTTGAGGACATCACTTACTAT
CCATTTCTTCATGTTAAAAGAAGTCATCTCAAACTCTTAGTTTTTTTTTT
TTACAACTATGTAATTTATATTCCATTTTACATAAGGATACACTTATTTG
TCAAGCTCAGCACAATCTGTAAATTTTTAACCTATGTTACACCATCTTCA
GTGCCAGTCTTGGGCAAAATTGTGCAAGAGGTGAAGTTTATATTTGAATA
TCCATTCTCGTTTTAGGACTCTTCTTCCATATTTAGTGTCATCTTGCCTC
CCTACCTTCCACATGCCCCATGACTTGATGCAGTTTTAATACTTGTAATT
CCCCTAACCATAAGATTACTGCTGCTGTGGATATCTCCATGAAGTTTTC
CCACTGAGTCACATCAGAAATGCCCTACATCTTATTTCCTCAGGGCTCAA
GAGAATCTGACAGATACCATAAAGGGATTTGACCTAATCACTAATTTTCA
GGTGGTGGCTGATGCTTTGAACATCTCTTTGCTGCCCAATCCATTAGCGA
CAGTAGGATTTTTCAAACCTGGTATGAATAGACAGAACCCTATCCAGTGG
AAGGAGAATTTAATAAAGATAGTGCTGAAAGAATTCCTTAGGTAATCTAT
AACTAGGACTACTCCTGGTAACAGTAATACATTCCATTGTTTTAGTAACC
AGAAATCTTCATGCAATGAAAAATACTTTAATTCATGAAGCTTACTTTTT
TTTTTTGGTGTCAGAGTCTCGCTCTTGTCACCCAGGCTGGAATGCAGTGG
CGCCATCTCAGCTCACTGCAACCTCCATCTCCCAGGTTCAAGCGATTCTC
GTGCCTCGGCCTCCTGAGTAGCTGGGATTACAGGCGTGTGCCACTACACT
CAACTAATTTTTGTATTTTAGGAGAGACGGGGTTTCACCCTGTTGGCCA
GGCTGGTCTCGAACTCCTGACCTCAAGTGATTCACCCACCTTGGCCTCAT
AAACCTGTTTTGCAGAACTCATTTATTCAGCAAATATTTATTGAGTGCCT
ACCAGATGCCAGTCACCGCACAAGGCACTGGGTATATGGTATCCCCAAAC -continued
AAGAGACATAATCCCGGTCCTTAGGTAGTGCTAGTGTGGTCTGTAATATC
TTACTAAGGCCTTTGGTATACGACCCAGAGATAACACGATGCGTATTTTA
GTTTTGCAAAGAAGGGGTTTGGTCTCTGTGCCAGCTCTATAATTGTTTTG
CTACGATTCCACTGAAACTCTTCGATCAAGCTACTTTATGTAAATCACTT
CATTGTTTTAAAGGAATAAACTTGATTATATTGTTTTTTTATTTGGCATA
ACTGTGATTCTTTTAGGACAATTACTGTACACATTAAGGTGTATGTCAGA
TATTCATATTGACCCAAATGTGTAATATTCCAGTTTTCTCTGCATAAGTA
ATTAAAATATACTTAAAAATTAATAGTTTTATCTGGGTACAAATAAACAG
GTGCCTGAACTAGTTCACAGACAAGGAAACTTCTATGTAAAAATCACTAT
GATTTCTGAATTGCTATGTGAAACTACAGATCTTTGGAACACTGTTTAGG
TAGGGTGTTAAGACTTACACAGTACCTCGTTTCTACACAGAGAAAGAAAT
GGCCATACTTCAGGAACTGCAGTGCTTATGAGGGGATATTTAGGCCTCTT
GAATTTTTGATGTAGATGGGCATTTTTTTAAGGTAGTGGTTAATTACCTT
TATGTGAACTTTGAATGGTTTAACAAAAGATTTGTTTTTGTAGAGATTTT
AAAGGGGGAGAATTCTAGAAATAAATGTTACCTAATTATTACAGCCTTAA
AGACAAAAATCCTTGTTGAAGTTTTTTAAAAAAAAGCTAAATTACATAGA
CTTAGGCATTAACATGTTTGTGGAAGAATATAGCAGACGTATATTGTATC
ATTTGAGTGAATGTTCCCAAGTAGGCATTCTAGGCTCTATTTAACTGAGT
CACACTGCATAGGAATTTAGAACCTAACTTTTATAGGTTATCAAAACTGT
TGTCACCATTGCACAATTTTGTCCTAATATATACATAGAAACTTTGTGGG
GCATGTTAAGTTACAGTTTGCACAAGTTCATCTCATTTGTATTCCATTGA
TTTTTTTTTTCTTCTAAACATTTTTTCTTCAAACAGTATATAACTTTTTT
TAGGGGATTTTTTTTTAGACAGCAAAAACTATCTGAAGATTTCCATTTGT
CAAAAAGTAATGATTTCTTGATAATTGTGTAGTAATGTTTTTTAGAACCC
AGCAGTTACCTTAAAGCTGAATTTATATTTAGTAACTTCTGTGTTAATAC
TGGATAGCATGAATTCTGCATTGAGAAACTGAATAGCTGTCATAAAATGA
AACTTTCTTTCTAAAGAAAGATACTCACATGAGTTCTTGAAGAATAGTCA
TAACTAGATTAAGATCTGTGTTTTAGTTTAATAGTTTGAAGTGCCTGTTT
GGGATAATGATAGGTAATTTAGATGAATTTAGGGGAAAAAAAGTTATCT
GCAGATATGTTGAGGGCCCATCTCTCCCCCCACACCCCCACAGAGCTAAC
TGGGTTACAGTGTTTTATCCGAAAGTTTCCAATTCCACTGTCTTGTGTTT
TCATGTTGAAAATACTTTTGCATTTTTCCTTTGAGTGCCAATTTCTTACT
AGTACTATTTCTTAATGTAACATGTTTACCTGGAATGTATTTTAACTATT
TTTGTATAGTGTAAACTGAAACATGCACATTTTGTACATTGTGCTTTCTT
TTGTGGGACATATGCAGTGTGATCCAGTTGTTTTCCATCATTTGGTTGCG
CTGACCTAGGAATGTTGGTCATATCAAACATTAAAAATGACCACTCTTTT
AATTGAAATTAACTTTTAAATGTTTATAGGAGTATGTGCTGTGAAGTGAT
CTAAAATTTGTAATATTTTTGTCATGAACTGTACTACTCCTAATTATTGT
AATGTAATAAAAATAGTTACAGTGACAAAAAAAAAAAAAAA The underlined sequences above correspond to KRAS RNA sequences targeted by exemplified KRAS-355 and KRAS-940 DsiRNA agents of the invention. Known SNPs within the above cDNA sequence include an A/T polymorphism at position 364 (dbSNP Accession No. rs17851045); a T/C polymorphism at position 824 (dbSNP Accession No. rs1137282); and a KRAS G12V mutant G/T polymorphism at position 216, as previously described in US 2005/0176045. These three polymorphic sites are shown in bold italics.

Wild-type KRAS Amino Acid Sequence NP_203524.1 (SEQ ID NO: 2; translation of NM_033360):

MTEYKLVVVGAGGVGKSALTIQLIQNHFVDEYDPTIEDSYRKQVVIDGET
CLLDILDTAGQEEYSAMRDQYMRTGEGFLCVFAINNTKSFEDIHHYREQI
KRVKDSEDVPMVLVGNKCDLPSRTVDTKQAQDLARSYGIPFIETSAKTRQ
RVEDAFYTLVREIRQYRLKKISKEEKTPGCVKIKKCIIM

Wild-type KRAS sequence (SEQ ID NO: 3; K-Ras4b—transcript variant b; GenBank Accession No. NM_004985.3):

GGCCGCGGCGGCGGAGGCAGCAGCGGCGGCGGCAGTGGCGGCGGCGAAGG

TGGCGGCGGCTCGGCCAGTACTCCCGGCCCCCGCCATTTCGGACTGGGAG

CGAGCGCGGCGCAGGCACTGAAGGCGGCGGCGGGGCCAGAGGCTCAGCGG

CTCCCAGGTGCGGGAGAGAGGCCTGCTGAAAATGACTGAATATAAACTTG

TGGTAGTTGGAGCTGGTGGCGTAGGCAAGAGTGCCTTGACGATACAGCTA

ATTCAGAATCATTTTGTGGACGAATATGATCCAACAATAGAGGATTCCTA

CAGGAAGCAAGTAGTAATTGATGGAGAAACCTGTCTCTTGGATATTCTCG

ACAC<u>AGCAGGTCAAGAGGAGTACAGTGCAAT</u>GAGGGACCAGTACATGAGG

ACTGGGGAGGGCTTTCTTTGTGTATTTGCCATAAATAATACTAAATCATT

TGAAGATATTCACCATTATAGAGAACAAATTAAAAGAGTTAAGGACTCTG

AAGATGTACCTATGGTCCTAGTAGGAAATAAATGTGATTTGCCTTCTAGA

ACAGTAGACACAAAACAGGCTCAGGACTTAGCAAGAAGTTATGGAATTCC

TTTTATTGAAACATCAGCAAAGACAAGACAGGGTGTTGATGATGCCTTCT

ATACATTAGTTCGAGAAATTCGAAAACATAAAGAAAAGATGAGCAAAGAT

GGTAAAAAGAAGAAAAAGAAGTCAAAGACAAAGTGTGTAATTATGTAAAT

ACAATTTGTACTTTTTTCTTAAGGCATACTAGTACAAGTGGTAATTTTTG

TACATTACACTAAAT<u>TATTAGCATTTGTTTTAGCATTACCTA</u>ATTTTTTT

CCTGCTCCATGCAGACTGTTAGCTTTTACCTTAAATGCTTATTTTAAAT

GACAGTGGAAGTTTTTTTTCCTCTAAGTGCCAGTATTCCCAGAGTTTTG

GTTTTTGAACTAGCAATGCCTGTGAAAAGAAACTGAATACCTAAGATTT

CTGTCTTGGGGTTTTTGGTGCATGCAGTTGATTACTTCTTATTTTTCTTA

CCAATTGTGAATGTTGGTGTGAAACAAATTAATGAAGCTTTTGAATCATC

CCTATTCTGTGTTTATCTAGTCACATAAATGGATTAATTACTAATTTCA

GTTGAGACCTTCTAATTGGTTTTTACTGAAACATTGAGGGAACACAAATT

TATGGGCTTCCTGATGATGATTCTTCTAGGCATCATGTCCTATAGTTTGT

CATCCCTGATGAATGTAAAGTTACACTGTTCACAAAGGTTTTGTCTCCTT

TCCACTGCTATTAGTCATGGTCACTCTCCCCAAAATATTATATTTTTCT

ATAAAAAGAAAAAATGGAAAAAAATTACAAGGCAATGGAAACTATTATA

AGGCCATTTCCTTTTCACATTAGATAAATTACTATAAAGACTCCTAATAG

CTTTTCCTGTTAAGGCAGACCCAGTATGAAATGGGGATTATTATAGCAAC

CATTTTGGGGCTATATTTACATGCTACTAAATTTTTATAATAATTGAAAA

GATTTTAACAAGTATAAAAAATTCTCATAGGAATTAAATGTAGTCTCCCT

GTGTCAGACTGCTCTTTCATAGTATAACTTTAAATCTTTTCTTCAACTTG

AGTCTTTGAAGATAGTTTTAATTCTGCTTGTGACATTAAAAGATTATTTG

GGCCAGTTATAGCTTATTAGGTGTTGAAGAGACCAAGGTTGCAAGGCCAG

GCCCTGTGTGAACCTTTGAGCTTTCATAGAGAGTTTCACAGCATGGACTG

TGTCCCCACGGTCATCCAGTGTTGTCATGCATTGGTTAGTCAAAATGGGG

AGGGACTAGGGCAGTTTGGATAGCTCAACAAGATACAATCTCACTCTGTG

GTGGTCCTGCTGACAAATCAAGAGCATTGCTTTTGTTTCTTAAGAAAACA

AACTCTTTTTTAAAAATTACTTTTAAATATTAACTCAAAAGTTGAGATTT

TGGGGTGGTGGTGTGCCAAGACATTAATTTTTTTTTAAACAATGAAGTG

AAAAAGTTTTACAATCTCTAGGTTTGGCTAGTTCTCTTAACACTGGTTAA

ATTAACATTGCATAAACACTTTTCAAGTCTGATCCATATTTAATAATGCT

TTAAAATAAAAATAAAAACAATCCTTTTGATAAATTTAAAATGTTACTTA

TTTTAAAATAAATGAAGTGAGATGGCATGGTGAGGTGAAAGTATCACTGG

ACTAGGAAGAAGGTGACTTAGGTTCTAGATAGGTGTCTTTTAGGACTCTG

ATTTTGAGGACATCACTTACTATCCATTTCTTCATGTTAAAAGAAGTCAT

CTCAAACTCTTAGTTTTTTTTTTTTACAACTATGTAATTTATATTCCATT

TACATAAGGATACACTTATTTGTCAAGCTCAGCACAATCTGTAAATTTTT

AACCTATGTTACACCATCTTCAGTGCCAGTCTTGGGCAAAATTGTGCAAG

AGGTGAAGTTTATATTTGAATATCCATTCTCGTTTTAGGACTCTTCTTCC

ATATTAGTGTCATCTTGCCTCCCTACCTTCCACATGCCCCATGACTTGAT

GCAGTTTTAATACTTGTAATTCCCCTAACCATAAGATTTACTGCTGCTGT

GGATATCTCCATGAAGTTTTCCCACTGAGTCACATCAGAAATGCCCTACA

TCTTATTTCCTCAGGGCTCAAGAGAATCTGACAGATACCATAAAGGGATT

TGACCTAATCACTAATTTTCAGGTGGTGGCTGATGCTTTGAACATCTCTT

TGCTGCCCAATCCATTAGCGAAGTAGGATTTTTCAAACCTGGTATGAATA

GACAGAACCCTATCCAGTGGAAGGAGAATTTAATAAAGATAGTGCTGAAA

GAATTCCTTAGGTAATCTATAACTAGGACTACTCCTGGTAACAGTAATAC

ATTCCATTGTTTAGTAACCAGAAATCTTCATGCAATGAAAAATACTTTA

ATTCATGAAGCTTACTTTTTTTTTTGGTGTCAGAGTCTCGCTCTTGTCA

CCCAGGCTGGAATGCAGTGGCGCCATCTCAGCTCACTGCAACCTCCATCT

CCCAGGTTCAAGCGATTCTCGTGCCTCGGCCTCCTGAGTAGCTGGGATTA

CAGGCGTGTGCCACTACACTCAACTAATTTTTGTATTTTTAGGAGAGACG

GGGTTTCACCCTGTTGGCCAGGCTGGTCTCGAACTCCTGACCTCAAGTGA

TTCACCCACCTTGGCCTCATAAACCTGTTTTGCAGAACTCATTTATTCAG

CAAATATTTATTGAGTGCCTACCAGATGCCAGTCACCGCACAAGGCACTG

GGTATATGGTATCCCCAAACAAGAGACATAATCCCGGTCCTTAGGTAGTG

CTAGTGTGGTCTGTAATATCTTACTAAGGCCTTTGGTATACGACCCAGAG

```
-continued
ATAACACGATGCGTATTTTAGTTTTGCAAAGAAGGGGTTTGGTCTCTGTG

CCAGCTCTATAATTGTTTTGCTACGATTCCACTGAAACTCTTCGATCAAG

CTACTTTATGTAAATCACTTCATTGTTTTAAAGGAATAAACTTGATTATA

TTGTTTTTTATTTGGCATAACTGTGATTCTTTTAGGACAATTACTGTAC

ACATTAAGGTGTATGTCAGATATTCATATTGACCCAAATGTGTAATATTC

CAGTTTTCTCTGCATAAGTAATTAAAATATACTTAAAAATTAATAGTTTT

ATCTGGGTACAAATAAACAGGTGCCTGAACTAGTTCACAGACAAGGAAAC

TTCTATGTAAAAATCACTATGATTTCTGAATTGCTATGTGAAACTACAGA

TCTTTGGAACACTGTTTAGGTAGGGTGTTAAGACTTACACAGTACCTCGT

TTCTACACAGAGAAAGAAATGGCCATACTTCAGGAACTGCAGTGCTTATG

AGGGGATATTTAGGCCTCTTGAATTTTTGATGTAGATGGGCATTTTTTA

AGGTAGTGGTTAATTACCTTTATGTGAACTTTGAATGGTTTAACAAAAGA

TTTGTTTTTGTAGAGATTTTAAAGGGGGAGAATTCTAGAAATAAATGTTA

CCTAATTATTACAGCCTTAAAGACAAAAATCCTTGTTGAAGTTTTTTAA

AAAAAGCTAAATTACATAGACTTAGGCATTAACATGTTTGTGGAAGAATA

TAGCAGACGTATATTGTATCATTTGAGTGAATGTTCCCAAGTAGGCATTC

TAGGCTCTATTTAACTGAGTCACACTGCATAGGAATTTAGAACCTAACTT

TTATAGGTTATCAAAACTGTTGTCACCATTGCACAATTTTGTCCTAATAT

ATACATAGAAACTTTGTGGGGCATGTTAAGTTACAGTTTGCACAAGTTCA

TCTCATTTGTATTCCATTGATTTTTTTTTCTTCTAAACATTTTTTCTTC

AAACAGTATATAACTTTTTTTAGGGGATTTTTTTTAGACAGCAAAAACT

ATCTGAAGATTTCCATTTGTCAAAAAGTAATGATTTCTTGATAATTGTGT

AGTAATGTTTTTAGAACCCAGCAGTTACCTTAAAGCTGAATTTATATTT

AGTAACTTCTGTGTTAATACTGGATAGCATGAATTCTGCATTGAGAAACT

GAATAGCTGTCATAAAATGAAACTTTCTTTCTAAAGAAAGATACTCACAT

GAGTTCTTGAAGAATAGTCATAACTAGATTAAGATCTGTGTTTTAGTTTA

ATAGTTTGAAGTGCCTGTTTGGGATAATGATAGGTAATTTAGATGAATTT

AGGGGAAAAAAAGTTATCTGCAGATATGTTGAGGGCCCATCTCTCCCCC

CACACCCCCACAGAGCTAACTGGGTTACAGTGTTTTATCCGAAAGTTTCC

AATTCCACTGTCTTGTGTTTTCATGTTGAAAATACTTTTGCATTTTTCCT

TTGAGTGCCAATTTCTTACTAGTACTATTTCTTAATGTAACATGTTTACC

TGGAATGTATTTTAACTATTTTTGTATAGTGTAAACTGAAACATGCACAT

TTTGTACATTGTGCTTTCTTTTGTGGGACATATGCAGTGTGATCCAGTTG

TTTTCCATCATTTGGTTGCGCTGACCTAGGAATGTTGGTCATATCAAACA

TTAAAAATGACCACTCTTTTAATTGAAATTAACTTTTAAATGTTTATAGG

AGTATGTGCTGTGAAGTGATCTAAAATTTGTAATATTTTTGTCATGAACT

GTACTACTCCTAATTATTGTAATGTAATAAAAATAGTTACAGTGACAAAA

AAAAAAAAAA
```

The underlined sequences above correspond to KRAS RNA sequences targeted by exemplified KRAS-355 and KRAS-940 DsiRNA agents of the invention. Known SNPs within the above cDNA sequence include an A/T polymorphism at position 364 (dbSNP Accession No. rs17851045); a T/C polymorphism at position 700 (dbSNP Accession No. rs1137282); and a KRAS G12V mutant G/T polymorphism at position 216, as previously described in US 2005/0176045. These three polymorphic sites are shown in bold italics.

Wild-type KRAS Amino Acid Sequence NP_004976.2 (SEQ ID NO: 4; translation of NM_004985):

MTEYKLVVVGAGGVGKSALTIQLIQNHFVDEYDPTIEDSYRKQVVIDGET

CLLDILDTAGQEEYSAMRDQYMRTGEGFLCVFAINNTKSFEDIHHYREQI

KRVKDSEDVPMVLVGNKCDLPSRTVDTKQAQDLARSYGIPFIETSAKTRQ

GVDDAFYTLVREIRKHKEKMSKDGKKKKKKSKTKCVIM

In Vitro Assay to Assess DsiRNA KRAS Inhibitory Activity

An in vitro assay that recapitulates RNAi in a cell-free system can be used to evaluate DsiRNA constructs targeting KRAS RNA sequence(s), and thus to assess KRAS-specific gene inhibitory activity (also referred to herein as KRAS inhibitory activity) of a DsiRNA. The assay comprises the system described by Tuschl et al., 1999, Genes and Development, 13, 3191-3197 and Zamore et al., 2000, Cell, 101, 25-33 adapted for use with DsiRNA agents directed against KRAS RNA. A Drosophila extract derived from syncytial blastoderm is used to reconstitute RNAi activity in vitro. Target RNA is generated via in vitro transcription from an appropriate KRAS expressing plasmid using T7 RNA polymerase or via chemical synthesis. Sense and antisense DsiRNA strands (for example 20 uM each) are annealed by incubation in buffer (such as 100 mM potassium acetate, 30 mM HEPES-KOH, pH 7.4, 2 mM magnesium acetate) for 1 minute at 90° C. followed by 1 hour at 37° C., then diluted in lysis buffer (for example 100 mM potassium acetate, 30 mM HEPES-KOH at pH 7.4, 2 mM magnesium acetate). Annealing can be monitored by gel electrophoresis on an agarose gel in TBE buffer and stained with ethidium bromide. The Drosophila lysate is prepared using zero to two-hour-old embryos from Oregon R flies collected on yeasted molasses agar that are dechorionated and lysed. The lysate is centrifuged and the supernatant isolated. The assay comprises a reaction mixture containing 50% lysate [vol/vol], RNA (10-50 pM final concentration), and 10% [vol/vol] lysis buffer containing DsiRNA (10 nM final concentration). The reaction mixture also contains 10 mM creatine phosphate, 10 ug/ml creatine phosphokinase, 100 mM GTP, 100 uM UTP, 100 uM CTP, 500 uM ATP, 5 mM DTT, 0.1 U/uL RNasin (Promega), and 100 uM of each amino acid. The final concentration of potassium acetate is adjusted to 100 mM. The reactions are pre-assembled on ice and preincubated at 25° C. for 10 minutes before adding RNA, then incubated at 25° C. for an additional 60 minutes. Reactions are quenched with 4 volumes of 1.25× Passive Lysis Buffer (Promega). Target RNA cleavage is assayed by RT-PCR analysis or other methods known in the art and are compared to control reactions in which DsiRNA is omitted from the reaction.

Alternately, internally-labeled target RNA for the assay is prepared by in vitro transcription in the presence of [alpha-$^{32}$P] CTP, passed over a G50 Sephadex column by spin chromatography and used as target RNA without further purification. Optionally, target RNA is 5'-$^{32}$P-end labeled using T4 polynucleotide kinase enzyme. Assays are performed as described above and target RNA and the specific RNA cleavage products generated by RNAi are visualized on an autoradiograph of a gel. The percentage of cleavage is determined by PHOSPHOR IMAGER® (autoradiography) quantitation of bands representing intact control RNA or RNA from control reactions without DsiRNA and the cleavage products generated by the assay.

In one embodiment, this assay is used to determine target sites in the KRAS RNA target for DsiRNA mediated RNAi cleavage, wherein a plurality of DsiRNA constructs are screened for RNAi mediated cleavage of the KRAS RNA target, for example, by analyzing the assay reaction by electrophoresis of labeled target RNA, or by northern blotting, as well as by other methodology well known in the art.

In certain embodiments, a DsiRNA of the invention is deemed to possess KRAS inhibitory activity if, e.g., a 50% reduction in KRAS RNA levels is observed in a system, cell, tissue or organism, relative to a suitable control. Additional metes and bounds for determination of KRAS inhibitory activity of a DsiRNA of the invention are described supra.

Conjugation and Delivery of Anti-KRAS DsiRNA Agents

In certain embodiments the present invention relates to a method for treating a subject having a KRAS-associated disease or disorder, or at risk of developing a KRAS-associated disease or disorder. In such embodiments, the DsiRNA can act as novel therapeutic agents for controlling the KRAS-associated disease or disorder. The method comprises administering a pharmaceutical composition of the invention to the patient (e.g., human), such that the expression, level and/or activity of a KRAS RNA is reduced. The expression, level and/or activity of a polypeptide encoded by a KRAS RNA might also be reduced by a DsiRNA of the instant invention, even where said DsiRNA is directed against a non-coding region of the KRAS transcript (e.g., a targeted 5' UTR or 3' UTR sequence). Because of their high specificity, the DsiRNAs of the present invention can specifically target KRAS sequences of cells and tissues, optionally in an allele-specific manner where polymorphic alleles exist within an individual and/or population.

In the treatment of a KRAS-associated disease or disorder, the DsiRNA can be brought into contact with the cells or tissue of a subject, e.g., the cells or tissue of a subject exhibiting disregulation of KRAS and/or otherwise targeted for reduction of KRAS levels. For example, DsiRNA substantially identical to all or part of a KRAS RNA sequence, may be brought into contact with or introduced into such a cell, either in vivo or in vitro. Similarly, DsiRNA substantially identical to all or part of a KRAS RNA sequence may administered directly to a subject having or at risk of developing a KRAS-associated disease or disorder.

Therapeutic use of the DsiRNA agents of the instant invention can involve use of formulations of DsiRNA agents comprising multiple different DsiRNA agent sequences. For example, two or more, three or more, four or more, five or more, etc. of the presently described agents can be combined to produce a formulation that, e.g., targets multiple different regions of the KRAS RNA, or that not only target KRAS RNA but also target, e.g., cellular target genes associated with a KRAS-associated disease or disorder. A DsiRNA agent of the instant invention may also be constructed such that either strand of the DsiRNA agent independently targets two or more regions of KRAS RNA, or such that one of the strands of the DsiRNA agent targets a cellular target gene of KRAS known in the art.

Use of multifunctional DsiRNA molecules that target more then one region of a target nucleic acid molecule can also provide potent inhibition of KRAS RNA levels and expression. For example, a single multifunctional DsiRNA construct of the invention can target both the KRAS-355 and KRAS-940 sites simultaneously; additionally and/or alternatively, single or multifunctional agents of the invention can be designed to selectively target one splice variant of KRAS over another.

Thus, the DsiRNA agents of the instant invention, individually, or in combination or in conjunction with other drugs, can be used to treat, inhibit, reduce, or prevent a KRAS-associated disease or disorder. For example, the DsiRNA molecules can be administered to a subject or can be administered to other appropriate cells evident to those skilled in the art, individually or in combination with one or more drugs under conditions suitable for the treatment.

The DsiRNA molecules also can be used in combination with other known treatments to treat, inhibit, reduce, or prevent a KRAS-associated disease or disorder in a subject or organism. For example, the described molecules could be used in combination with one or more known compounds, treatments, or procedures to treat, inhibit, reduce, or prevent a KRAS-associated disease or disorder in a subject or organism as are known in the art.

A DsiRNA agent of the invention can be conjugated (e.g., at its 5' or 3' terminus of its sense or antisense strand) or unconjugated to another moiety (e.g. a non-nucleic acid moiety such as a peptide), an organic compound (e.g., a dye, cholesterol, or the like). Modifying DsiRNA agents in this way may improve cellular uptake or enhance cellular targeting activities of the resulting DsiRNA agent derivative as compared to the corresponding unconjugated DsiRNA agent, are useful for tracing the DsiRNA agent derivative in the cell, or improve the stability of the DsiRNA agent derivative compared to the corresponding unconjugated DsiRNA agent.

Methods of Introducing Nucleic Acids, Vectors, and Host Cells

DsiRNA agents of the invention may be directly introduced into a cell (i.e., intracellularly); or introduced extracellularly into a cavity, interstitial space, into the circulation of an organism, introduced orally, or may be introduced by bathing a cell or organism in a solution containing the nucleic acid. Vascular or extravascular circulation, the blood or lymph system, and the cerebrospinal fluid are sites where the nucleic acid may be introduced.

The DsiRNA agents of the invention can be introduced using nucleic acid delivery methods known in art including injection of a solution containing the nucleic acid, bombardment by particles covered by the nucleic acid, soaking the cell or organism in a solution of the nucleic acid, or electroporation of cell membranes in the presence of the nucleic acid. Other methods known in the art for introducing nucleic acids to cells may be used, such as lipid-mediated carrier transport, chemical-mediated transport, and cationic liposome transfection such as calcium phosphate, and the like. The nucleic acid may be introduced along with other components that perform one or more of the following activities: enhance nucleic acid uptake by the cell or otherwise increase inhibition of the target KRAS RNA.

A cell having a target KRAS RNA may be from the germ line or somatic, totipotent or pluripotent, dividing or non-dividing, parenchyma or epithelium, immortalized or transformed, or the like. The cell may be a stem cell or a differentiated cell. Cell types that are differentiated include adipocytes, fibroblasts, myocytes, cardiomyocytes, endothelium, neurons, glia, blood cells, megakaryocytes, lymphocytes, macrophages, neutrophils, eosinophils, basophils, mast cells, leukocytes, granulocytes, keratinocytes, chondrocytes, osteoblasts, osteoclasts, hepatocytes, and cells of the endocrine or exocrine glands.

Depending on the particular target KRAS RNA sequence and the dose of DsiRNA agent material delivered, this process may provide partial or complete loss of function for the KRAS RNA. A reduction or loss of RNA levels or expression (either KRAS RNA expression or encoded polypeptide expression) in at least 50%, 60%, 70%, 80%, 90%, 95% or 99% or more of targeted cells is exemplary. Inhibition of KRAS RNA levels or expression refers to the absence (or observable decrease) in the level of KRAS RNA or KRAS RNA-encoded protein. Specificity refers to the ability to inhibit the KRAS RNA without manifest effects on other genes of the cell. The consequences of inhibition can be confirmed by examination of the outward properties of the cell or organism or by biochemical techniques such as RNA solution hybridization, nuclease protection, Northern hybridization, reverse transcription, gene expression monitoring with a microarray, antibody binding, enzyme linked immunosorbent assay (ELISA), Western blotting, radioimmunoassay (RIA), other immunoassays, and fluorescence activated cell analysis (FACS). Inhibition of target KRAS RNA sequence(s) by the DsiRNA agents of the invention also can be measured based upon the effect of administration of such DsiRNA agents upon development/progression of a KRAS-associated disease or disorder, e.g., tumor formation, growth, metastasis, etc., either in vivo or in vitro. Treatment and/or reductions in tumor or cancer cell levels can include halting or reduction of growth of tumor or cancer cell levels or reductions of, e.g., 10%, 20%, 30%, 40%, 50%, 60%, 70%, 80%, 90%, 95% or 99% or more, and can also be measured in logarithmic terms, e.g., 10-fold, 100-fold, 1000-fold, $10^5$-fold, $10^6$-fold, $10^7$-fold reduction in cancer cell levels could be achieved via administration of the DsiRNA agents of the invention to cells, a tissue, or a subject.

For RNA-mediated inhibition in a cell line or whole organism, expression a reporter or drug resistance gene whose protein product is easily assayed can be measured. Such reporter genes include acetohydroxyacid synthase (AHAS), alkaline phosphatase (AP), beta galactosidase (LacZ), beta glucoronidase (GUS), chloramphenicol acetyltransferase (CAT), green fluorescent protein (GFP), horseradish peroxidase (HRP), luciferase (Luc), nopaline synthase (NOS), octopine synthase (OCS), and derivatives thereof. Multiple selectable markers are available that confer resistance to ampicillin, bleomycin, chloramphenicol, gentarnycin, hygromycin, kanamycin, lincomycin, methotrexate, phosphinothricin, puromycin, and tetracyclin. Depending on the assay, quantitation of the amount of gene expression allows one to determine a degree of inhibition which is greater than 10%, 33%, 50%, 90%, 95% or 99% as compared to a cell not treated according to the present invention.

Lower doses of injected material and longer times after administration of RNA silencing agent may result in inhibition in a smaller fraction of cells (e.g., at least 10%, 20%, 50%, 75%, 90%, or 95% of targeted cells). Quantitation of gene expression in a cell may show similar amounts of inhibition at the level of accumulation of target KRAS RNA or translation of target protein. As an example, the efficiency of inhibition may be determined by assessing the amount of gene product in the cell; RNA may be detected with a hybridization probe having a nucleotide sequence outside the region used for the inhibitory DsiRNA, or translated polypeptide may be detected with an antibody raised against the polypeptide sequence of that region.

The DsiRNA agent may be introduced in an amount which allows delivery of at least one copy per cell. Higher doses (e.g., at least 5, 10, 100, 500 or 1000 copies per cell) of material may yield more effective inhibition; lower doses may also be useful for specific applications.

Pharmaceutical Compositions

In certain embodiments, the present invention provides for a pharmaceutical composition comprising the DsiRNA agent of the present invention. The DsiRNA agent sample can be suitably formulated and introduced into the environment of the cell by any means that allows for a sufficient portion of the sample to enter the cell to induce gene silencing, if it is to occur. Many formulations for dsRNA are known in the art and can be used so long as the dsRNA gains entry to the target cells so that it can act. See, e.g., U.S. published patent application Nos. 2004/0203145 A1 and 2005/0054598 A1. For example, the DsiRNA agent of the instant invention can be formulated in buffer solutions such as phosphate buffered saline solutions, liposomes, micellar structures, and capsids. Formulations of DsiRNA agent with cationic lipids can be used to facilitate transfection of the DsiRNA agent into cells. For example, cationic lipids, such as lipofectin (U.S. Pat. No. 5,705,188), cationic glycerol derivatives, and polycationic molecules, such as polylysine (published PCT International Application WO 97/30731), can be used. Suitable lipids include Oligofectamine, Lipofectamine (Life Technologies), NC388 (Ribozyme Pharmaceuticals, Inc., Boulder, Colo.), or FuGene 6 (Roche) all of which can be used according to the manufacturer's instructions.

Such compositions typically include the nucleic acid molecule and a pharmaceutically acceptable carrier. As used herein the language "pharmaceutically acceptable carrier" includes saline, solvents, dispersion media, coatings, antibacterial and antifungal agents, isotonic and absorption delaying agents, and the like, compatible with pharmaceutical administration. Supplementary active compounds can also be incorporated into the compositions.

A pharmaceutical composition is formulated to be compatible with its intended route of administration. Examples of routes of administration include parenteral, e.g., intravenous, intradermal, subcutaneous, oral (e.g., inhalation), transdermal (topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringability exists. It should be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyetheylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in an appropriate solvent with one or a combination of ingredients enumerated above, as required, followed by filtered sterilization. Generally, dispersions are prepared by incorporating the active compound into a sterile vehicle, which contains a basic dispersion medium and the required other ingredients from those enumerated above. In the case of sterile powders for the preparation of sterile injectable solutions, the preferred methods of preparation are vacuum drying and freeze-drying which yields a powder of the active ingredient plus any additional desired ingredient from a previously sterile-filtered solution thereof.

Oral compositions generally include an inert diluent or an edible carrier. For the purpose of oral therapeutic administration, the active compound can be incorporated with excipients and used in the form of tablets, troches, or capsules, e.g., gelatin capsules. Oral compositions can also be prepared using a fluid carrier for use as a mouthwash. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer. Such methods include those described in U.S. Pat. No. 6,468,798.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

The compounds can also be administered by transfection or infection using methods known in the art, including but not limited to the methods described in McCaffrey et al. (2002), Nature, 418(6893), 38-9 (hydrodynamic transfection); Xia et al. (2002), Nature Biotechnol., 20(10), 1006-10 (viral-mediated delivery); or Putnam (1996), Am. J. Health Syst. Pharm. 53(2), 151-160, erratum at Am. J. Health Syst. Pharm. 53(3), 325 (1996).

The compounds can also be administered by a method suitable for administration of nucleic acid agents, such as a DNA vaccine. These methods include gene guns, bio injectors, and skin patches as well as needle-free methods such as the micro-particle DNA vaccine technology disclosed in U.S. Pat. No. 6,194,389, and the mammalian transdermal needle-free vaccination with powder-form vaccine as disclosed in U.S. Pat. No. 6,168,587. Additionally, intranasal delivery is possible, as described in, inter alia, Hamajima et al. (1998), Clin. Immunol. Immunopathol., 88(2), 205-10. Liposomes (e.g., as described in U.S. Pat. No. 6,472,375) and microencapsulation can also be used. Biodegradable targetable microparticle delivery systems can also be used (e.g., as described in U.S. Pat. No. 6,471,996).

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Such formulations can be prepared using standard techniques. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds which exhibit high therapeutic indices are preferred. While compounds that exhibit toxic side effects may be used, care should be taken to design a delivery system that targets such compounds to the site of affected tissue in order to minimize potential damage to uninfected cells and, thereby, reduce side effects.

The data obtained from the cell culture assays and animal studies can be used in formulating a range of dosage for use in humans. The dosage of such compounds lies preferably within a range of circulating concentrations that include the $ED_{50}$ with little or no toxicity. The dosage may vary within this range depending upon the dosage form employed and the route of administration utilized. For a compound used in the method of the invention, the therapeutically effective dose can be estimated initially from cell culture assays. A dose may be formulated in animal models to achieve a circulating plasma concentration range that includes the $IC_{50}$ (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

As defined herein, a therapeutically effective amount of a nucleic acid molecule (i.e., an effective dosage) depends on the nucleic acid selected. For instance, if a plasmid encoding a DsiRNA agent is selected, single dose amounts in the range of approximately 1 pg to 1000 mg may be administered; in some embodiments, 10, 30, 100, or 1000 pg, or 10, 30, 100, or 1000 ng, or 10, 30, 100, or 1000 µg, or 10, 30, 100, or 1000 mg may be administered. In some embodiments, 1-5 g of the compositions can be administered. The compositions can be administered one from one or more times per day to one or more times per week; including once every other day. The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a protein, polypeptide, or antibody can include a single treatment or, preferably, can include a series of treatments.

The nucleic acid molecules of the invention can be inserted into expression constructs, e.g., viral vectors, retroviral vectors, expression cassettes, or plasmid viral vectors, e.g., using methods known in the art, including but not limited to those described in Xia et al., (2002), supra. Expression constructs can be delivered to a subject by, for example, inhalation, orally, intravenous injection, local administration (see U.S. Pat. No. 5,328,470) or by stereotactic injection (see e.g., Chen et al. (1994), Proc. Natl. Acad. Sci. USA, 91, 3054-3057). The pharmaceutical preparation of the delivery vector can include the vector in an acceptable diluent, or can comprise a slow release matrix in which the delivery vehicle is imbedded. Alternatively, where the complete delivery vector can be produced intact from recombinant cells, e.g., retroviral vectors, the pharmaceutical preparation can include one or more cells which produce the gene delivery system.

The expression constructs may be constructs suitable for use in the appropriate expression system and include, but are not limited to retroviral vectors, linear expression cassettes, plasmids and viral or virally-derived vectors, as known in the art. Such expression constructs may include one or more inducible promoters, RNA Pol III promoter systems such as U6 snRNA promoters or H1 RNA polymerase III promoters, or other promoters known in the art. The constructs can include one or both strands of the siRNA. Expression constructs expressing both strands can also include loop structures linking both strands, or each strand can be separately transcribed from separate promoters within the same construct. Each strand can also be transcribed from a separate expression construct, e.g., Tuschl (2002, *Nature Biotechnol* 20: 500-505).

It can be appreciated that the method of introducing DsiRNA agents into the environment of the cell will depend on the type of cell and the make up of its environment. For example, when the cells are found within a liquid, one preferable formulation is with a lipid formulation such as in lipofectamine and the DsiRNA agents can be added directly to the liquid environment of the cells. Lipid formulations can also be administered to animals such as by intravenous, intramuscular, or intraperitoneal injection, or orally or by inhalation or other methods as are known in the art. When the formulation is suitable for administration into animals such as mammals and more specifically humans, the formulation is also pharmaceutically acceptable. Pharmaceutically acceptable formulations for administering oligonucleotides are known and can be used. In some instances, it may be preferable to formulate DsiRNA agents in a buffer or saline solution and directly inject the formulated DsiRNA agents into cells, as in studies with oocytes. The direct injection of DsiRNA agents duplexes may also be done. For suitable methods of introducing dsRNA (e.g., DsiRNA agents), see U.S. published patent application No. 2004/0203145 A1.

Suitable amounts of a DsiRNA agent must be introduced and these amounts can be empirically determined using standard methods. Typically, effective concentrations of individual DsiRNA agent species in the environment of a cell will be 50 nanomolar or less, 10 nanomolar or less, or compositions in which concentrations of 1 nanomolar or less can be used. In another embodiment, methods utilizing a concentration of 200 picomolar or less, 100 picomolar or less, 50 picomolar or less, 20 picomolar or less, and even a concentration of 10 picomolar or less, 5 picomolar or less, 2 picomolar or less or 1 picomolar or less can be used in many circumstances.

The method can be carried out by addition of the DsiRNA agent compositions to an extracellular matrix in which cells can live provided that the DsiRNA agent composition is formulated so that a sufficient amount of the DsiRNA agent can enter the cell to exert its effect. For example, the method is amenable for use with cells present in a liquid such as a liquid culture or cell growth media, in tissue explants, or in whole organisms, including animals, such as mammals and especially humans.

The level or activity of a KRAS RNA can be determined by a suitable method now known in the art or that is later developed. It can be appreciated that the method used to measure a target RNA and/or the expression of a target RNA can depend upon the nature of the target RNA. For example, where the target KRAS RNA sequence encodes a protein, the term "expression" can refer to a protein or the KRAS RNA/transcript derived from the KRAS gene (either genomic or of exogenous origin). In such instances the expression of the target KRAS RNA can be determined by measuring the amount of KRAS RNA/transcript directly or by measuring the amount of KRas protein. Protein can be measured in protein assays such as by staining or immunoblotting or, if the protein catalyzes a reaction that can be measured, by measuring reaction rates. All such methods are known in the art and can be used. Where target KRAS RNA levels are to be measured, art-recognized methods for detecting RNA levels can be used (e.g., RT-PCR, Northern Blotting, etc.). In targeting KRAS RNAs with the DsiRNA agents of the instant invention, it is also anticipated that measurement of the efficacy of a DsiRNA agent in reducing levels of KRAS RNA or protein in a subject, tissue, in cells, either in vitro or in vivo, or in cell extracts can also be used to determine the extent of reduction of KRAS-associated phenotypes (e.g., disease or disorders, e.g., cancer or tumor formation, growth, metastasis, spread, etc.). The above measurements can be made on cells, cell extracts, tissues, tissue extracts or other suitable source material.

The determination of whether the expression of a KRAS RNA has been reduced can be by a suitable method that can reliably detect changes in RNA levels. Typically, the determination is made by introducing into the environment of a cell undigested DsiRNA such that at least a portion of that DsiRNA agent enters the cytoplasm, and then measuring the level of the target RNA. The same measurement is made on identical untreated cells and the results obtained from each measurement are compared.

The DsiRNA agent can be formulated as a pharmaceutical composition which comprises a pharmacologically effective amount of a DsiRNA agent and pharmaceutically acceptable carrier. A pharmacologically or therapeutically effective amount refers to that amount of a DsiRNA agent effective to produce the intended pharmacological, therapeutic or preventive result. The phrases "pharmacologically effective amount" and "therapeutically effective amount" or simply "effective amount" refer to that amount of an RNA effective to produce the intended pharmacological, therapeutic or preventive result. For example, if a given clinical treatment is considered effective when there is at least a 20% reduction in a measurable parameter associated with a disease or disorder, a therapeutically effective amount of a drug for the treatment of that disease or disorder is the amount necessary to effect at least a 20% reduction in that parameter.

Suitably formulated pharmaceutical compositions of this invention can be administered by means known in the art such as by parenteral routes, including intravenous, intramuscular, intraperitoneal, subcutaneous, transdermal, airway (aerosol), rectal, vaginal and topical (including buccal and sublingual) administration. In some embodiments, the pharmaceutical compositions are administered by intravenous or intraparenteral infusion or injection.

In general, a suitable dosage unit of dsRNA will be in the range of 0.001 to 0.25 milligrams per kilogram body weight of the recipient per day, or in the range of 0.01 to 20 micrograms per kilogram body weight per day, or in the range of 0.01 to 10 micrograms per kilogram body weight per day, or in the range of 0.10 to 5 micrograms per kilogram body weight per day, or in the range of 0.1 to 2.5 micrograms per kilogram body weight per day. Pharmaceutical composition comprising the dsRNA can be administered once daily. However, the therapeutic agent may also be dosed in dosage units containing two, three, four, five, six or more sub-doses administered at appropriate intervals throughout the day. In that case, the dsRNA contained in each sub-dose must be correspondingly smaller in order to achieve the total daily dosage unit. The dosage unit can also be compounded for a single dose over several days, e.g., using a conventional sustained release formulation which provides sustained and consistent release of the dsRNA over a several day period. Sustained release formulations are well known in the art. In this embodiment, the dosage unit contains a corresponding multiple of the daily dose. Regardless of the formulation, the pharmaceutical composition must contain dsRNA in a quantity sufficient to inhibit expression of the target gene in the animal or human being treated. The composition can be compounded in such a way that the sum of the multiple units of dsRNA together contain a sufficient dose.

Data can be obtained from cell culture assays and animal studies to formulate a suitable dosage range for humans. The dosage of compositions of the invention lies within a range of circulating concentrations that include the $ED_{50}$ (as determined by known methods) with little or no toxicity. The dosage may vary within this range depending upon the dosage form employed and the route of administration utilized. For a compound used in the method of the invention, the therapeutically effective dose can be estimated initially from cell culture assays. A dose may be formulated in animal models to achieve a circulating plasma concentration range of the compound that includes the $IC_{50}$ (i.e., the concentration of the test compound which achieves a half-maximal inhibition of symptoms) as determined in cell culture. Such information can be used to more accurately determine useful doses in humans. Levels of dsRNA in plasma may be measured by standard methods, for example, by high performance liquid chromatography.

The pharmaceutical compositions can be included in a kit, container, pack, or dispenser together with instructions for administration.

Methods of Treatment

The present invention provides for both prophylactic and therapeutic methods of treating a subject at risk of (or susceptible to) a disease or disorder caused, in whole or in part, by KRAS (e.g., misregulation and/or elevation of KRAS transcript and/or KRas protein levels), or treatable via selective targeting of KRAS.

"Treatment", or "treating" as used herein, is defined as the application or administration of a therapeutic agent (e.g., a DsiRNA agent or vector or transgene encoding same) to a patient, or application or administration of a therapeutic agent to an isolated tissue or cell line from a patient, who has the disease or disorder, a symptom of disease or disorder or a predisposition toward a disease or disorder, with the purpose to cure, heal, alleviate, relieve, alter, remedy, ameliorate, improve or affect the disease or disorder, the symptoms of the disease or disorder, or the predisposition toward disease.

In one aspect, the invention provides a method for preventing in a subject, a disease or disorder as described above (including, e.g., prevention of the commencement of transforming events within a subject via inhibition of KRAS expression), by administering to the subject a therapeutic agent (e.g., a DsiRNA agent or vector or transgene encoding same). Subjects at risk for the disease can be identified by, for example, one or a combination of diagnostic or prognostic assays as described herein. Administration of a prophylactic agent can occur prior to the detection of, e.g., cancer in a subject, or the manifestation of symptoms characteristic of the disease or disorder, such that the disease or disorder is prevented or, alternatively, delayed in its progression.

Another aspect of the invention pertains to methods of treating subjects therapeutically, i.e., altering the onset of symptoms of the disease or disorder. These methods can be performed in vitro (e.g., by culturing the cell with the DsiRNA agent) or, alternatively, in vivo (e.g., by administering the DsiRNA agent to a subject).

With regards to both prophylactic and therapeutic methods of treatment, such treatments may be specifically tailored or modified, based on knowledge obtained from the field of pharmacogenomics. "Pharmacogenomics", as used herein, refers to the application of genomics technologies such as gene sequencing, statistical genetics, and gene expression analysis to drugs in clinical development and on the market. More specifically, the term refers the study of how a patient's genes determine his or her response to a drug (e.g., a patient's "drug response phenotype", or "drug response genotype"). Thus, another aspect of the invention provides methods for tailoring an individual's prophylactic or therapeutic treatment with either the target KRAS RNA molecules of the present invention or target KRAS RNA modulators according to that individual's drug response genotype. Pharmacogenomics allows a clinician or physician to target prophylactic or therapeutic treatments to patients who will most benefit from the treatment and to avoid treatment of patients who will experience toxic drug-related side effects.

Therapeutic agents can be tested in an appropriate animal model. For example, a DsiRNA agent (or expression vector or transgene encoding same) as described herein can be used in an animal model to determine the efficacy, toxicity, or side effects of treatment with said agent. Alternatively, an agent (e.g., a therapeutic agent) can be used in an animal model to determine the mechanism of action of such an agent.

Models Useful to Evaluate the Down-Regulation of KRAS mRNA Levels and Expression Cell Culture Kita et al., 1999, *Int. J. Cancer*, 80, 553-558, describes the growth inhibition of human pancreatic cancer cell lines by antisense oligonucleotides specific to mutated KRAS genes. Antisense oligonucleotides were transfected to the transformed cells using liposomes. Cellular proliferation, KRAS mRNA expression, and KRas protein synthesis were all evaluated as endpoints. Sato et al., 2000, *Cancer Lett.*, 155, 153-161, describes another human pancreatic cancer cell line, HOR-P1, that is characterized by high angiogenic activity and metastatic potential. Genetic and molecular analysis of this cell line revealed both increased telomerase activity and a mutation in the KRAS oncogene.

The DsiRNA agents of the invention can be tested for cleavage activity in vivo, for example, using the following procedure. The nucleotide sequences within the KRAS cDNA targeted by the DsiRNA agents of the invention are shown in the above KRAS sequences.

The DsiRNA reagents of the invention can be tested in cell culture using HeLa or other mammalian cells to determine the extent of KRAS RNA and KRas protein inhibition. DsiRNA reagents (e.g., see FIGS. 1 and 4, and above-recited structures) are selected against the KRAS target as described herein. KRAS RNA inhibition is measured after delivery of these reagents by a suitable transfection agent to, for example, cultured HeLa cells or other transformed or non-transformed mammalian cells in culture. Relative amounts of target KRAS RNA are measured versus actin or other appropriate control using real-time PCR monitoring of amplification (e.g., ABI 7700 TAQMAN®). A comparison is made to a mixture of oligonucleotide sequences made to unrelated targets or to a randomized DsiRNA control with the same overall length and chemistry, but randomly substituted at each position, or simply to appropriate vehicle-treated or untreated controls. Primary and secondary lead reagents are chosen for the target and optimization performed. After an optimal transfection agent concentration is chosen, a RNA time-course of inhibition is performed with the lead DsiRNA molecule.

TAQMAN® (Real-Time PCR Monitoring of Amplification) and Lightcycler Quantification of mRNA Total RNA is prepared from cells following DsiRNA delivery, for example, using Ambion Rnaqueous 4-PCR purification kit for large scale extractions, or Ambion Rnaqueous-96 purification kit for 96-well assays. For Taqman analysis, dual-labeled probes are synthesized with, for example, the reporter dyes FAM or VIC covalently linked at the 5'-end and the quencher dye TAMARA conjugated to the 3'-end. One-step RT-PCR amplifications are performed on, for example, an ABI PRISM 7700 Sequence detector using 50 uL reactions consisting of 10 uL total RNA, 100 nM forward primer, 100 mM reverse primer, 100 nM probe, 1×TaqMan PCR reaction buffer (PE-Applied Biosystems), 5.5 mM MgCl2, 100 uM each dATP, dCTP, dGTP and dTTP, 0.2U RNase Inhibitor (Promega), 0.025U AmpliTaq Gold (PE-Applied Biosystems) and 0.2U M-MLV Reverse Transcriptase (Promega). The thermal cycling conditions can consist of 30 minutes at 48° C., 10 minutes at 95° C., followed by 40 cycles of 15 seconds at 95° C. and 1 minute at 60° C. Quantitation of target KRAS mRNA level is determined relative to standards generated from serially diluted total cellular RNA (300, 100, 30, 10 ng/rxn) and normalizing to, for example, 36B4 mRNA in either parallel or same tube TaqMan reactions.

Western Blotting

Nuclear extracts can be prepared using a standard micro preparation technique (see for example Andrews and Faller, 1991, Nucleic Acids Research, 19, 2499). Protein extracts from supernatants are prepared, for example using TCA precipitation. An equal volume of 20% TCA is added to the cell supernatant, incubated on ice for 1 hour and pelleted by centrifugation for 5 minutes. Pellets are washed in acetone, dried and resuspended in water. Cellular protein extracts are run on a 10% Bis-Tris NuPage (nuclear extracts) or 4-12% Tris-Glycine (supernatant extracts) polyacrylamide gel and transferred onto nitro-cellulose membranes. Non-specific binding can be blocked by incubation, for example, with 5% non-fat milk for 1 hour followed by primary antibody for 16 hours at 4° C. Following washes, the secondary antibody is applied, for example (1:10,000 dilution) for 1 hour at room temperature and the signal detected with SuperSignal reagent (Pierce).

In several cell culture systems, cationic lipids have been shown to enhance the bioavailability of oligonucleotides to cells in culture (Bennet, et al., 1992, Mol. Pharmacology, 41, 1023-1033). In one embodiment, DsiRNA molecules of the invention are complexed with cationic lipids for cell culture experiments. DsiRNA and cationic lipid mixtures are prepared in serum-free DMEM immediately prior to addition to the cells. DMEM plus additives are warmed to room temperature (about 20-25° C.) and cationic lipid is added to the final desired concentration and the solution is vortexed briefly. DsiRNA molecules are added to the final desired concentration and the solution is again vortexed briefly and incubated for 10 minutes at room temperature. In dose response experiments, the RNA/lipid complex is serially diluted into DMEM following the 10 minute incubation.

Animal Models

Evaluating the efficacy of anti-KRAS DsiRNA agents in animal models is an important prerequisite to human clinical trials. Various animal models of cancer and/or proliferative diseases, conditions, or disorders as are known in the art can be adapted for use for pre-clinical evaluation of the efficacy of DsiRNA compositions of the invention in modulating KRAS gene expression toward therapeutic use.

As in cell culture models, the most Ras sensitive mouse tumor xenografts are those derived from cancer cells that express mutant Ras proteins. Nude mice bearing H-Ras transformed bladder cancer cell xenografts were sensitive to an anti-Ras antisense nucleic acid, resulting in an 80% inhibition of tumor growth after a 31 day treatment period (Wickstrom, 2001, *Mol. Biotechnol.*, 18, 35-35). Zhang et al., 2000, *Gene Ther.*, 7, 2041, describes an anti-KRAS ribozyme adenoviral vector (KRbz-ADV) targeting a KRAS mutant (KRAS codon 12 GGT to GTT; H441 and H1725 cells respectively). Non-small cell lung cancer cells (NSCLC H441 and H1725 cells) that express the mutant KRas protein were used in nude mouse xenografts compared to NSCLC H1650 cells that lack the relevant mutation. Pre-treatment with KRbz-ADV completely abrogated engraftment of both H441 and H1725 cells and compared to 100% engraftment and tumor growth in animals that received untreated tumor cells or a control vector. Additional mouse models of KRAS misregulation/mutation have also been described (e.g., in Kim et al. *Cell* 121: 823-835, which identified a role of KRAS in promoting lung adenocarcinomas). The above studies provide proof that inhibition of Ras expression (e.g., KRAS expression) by anti-Ras agents causes inhibition of tumor growth in animals.

As such, these models can be used in evaluating the efficacy of DsiRNA molecules of the invention in inhibiting KRAS levels, expression, tumor/cancer formation, growth, spread, development of other KRAS-associated phenotypes, diseases or disorders, etc. These models and others can similarly be used to evaluate the safety/toxicity and efficacy of DsiRNA molecules of the invention in a pre-clinical setting.

Specific examples of animal model systems useful for evaluation of the KRAS-targeting DsiRNAs of the instant invention include wild-type mice, orthotopic HCC xenograft tumor model mice (e.g., Hep3B and HepG2) and disseminated melanoma model mice. In an exemplary in vivo experiment, DsiRNAs of the invention are tail vein injected into such mouse models at doses ranging from 1 to 10 mg/kg or, alternatively, repeated doses are administered at single-dose IC$_{50}$ levels, and organs (e.g., liver, kidney, lung, pancreas, colon, skin, spleen, bone marrow, lymph nodes, mammary fat pad, etc.) are harvested 24 hours after administration of the final dose. Such organs are then evaluated for mouse and/or human KRAS levels, depending upon the model used. Duration of action can also be examined at, e.g., 1, 4, 7, 14, 21 or more days after final DsiRNA administration.

The practice of the present invention employs, unless otherwise indicated, conventional techniques of chemistry, molecular biology, microbiology, recombinant DNA, genetics, immunology, cell biology, cell culture and transgenic biology, which are within the skill of the art. See, e.g., Maniatis et al., 1982, Molecular Cloning (Cold Spring Harbor Laboratory Press, Cold Spring Harbor, N.Y.); Sambrook et al., 1989, Molecular Cloning, 2nd Ed. (Cold Spring Harbor Laboratory Press, Cold Spring Harbor, N.Y.); Sambrook and Russell, 2001, Molecular Cloning, 3rd Ed. (Cold Spring Harbor Laboratory Press, Cold Spring Harbor, N.Y.); Ausubel et al., 1992), Current Protocols in Molecular Biology (John Wiley & Sons, including periodic updates); Glover, 1985, DNA Cloning (IRL Press, Oxford); Anand, 1992; Guthrie and Fink, 1991; Harlow and Lane, 1988, Antibodies, (Cold Spring Harbor Laboratory Press, Cold Spring Harbor, N.Y.); Jakoby and Pastan, 1979; Nucleic Acid Hybridization (B. D. Hames & S. J. Higgins eds. 1984); Transcription And Translation (B. D. Hames & S. J. Higgins eds. 1984); Culture Of Animal Cells (R. I. Freshney, Alan R. Liss, Inc., 1987); Immobilized Cells And Enzymes (IRL Press, 1986); B. Perbal, A Practical Guide To Molecular Cloning (1984); the treatise, Methods In Enzymology (Academic Press, Inc., N.Y.); Gene Transfer Vectors For Mammalian Cells (J. H. Miller and M. P. Calos eds., 1987, Cold Spring Harbor Laboratory); Methods In Enzymology, Vols. 154 and 155 (Wu et al. eds.), Immunochemical Methods In Cell And Molecular Biology (Mayer and Walker, eds., Academic Press, London, 1987); Handbook Of Experimental Immunology, Volumes I-IV (D. M. Weir and C. C. Blackwell, eds., 1986); Riott, Essential Immunology, 6th Edition, Blackwell Scientific Publications, Oxford, 1988; Hogan et al., Manipulating the Mouse Embryo, (Cold Spring Harbor Laboratory Press, Cold Spring Harbor, N.Y., 1986); Westerfield, M., The zebrafish book. A guide for the laboratory use of zebrafish (Danio rerio), (4th Ed., Univ. of Oregon Press, Eugene, 2000).

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

The present invention is described by reference to the following Examples, which are offered by way of illustration and are not intended to limit the invention in any manner. Standard techniques well known in the art or the techniques specifically described below were utilized.

Example 1

Anti-KRAS DsiRNA Design

Preferred anti-KRAS DsiRNA agents were selected from a pre-screened population of DsiRNAs. Design of DsiRNAs can optionally involve use of predictive scoring algorithms that perform in silico assessments of the projected activity/efficacy of a number of possible DsiRNAs spanning a region of sequence.

Example 2

Preparation of Double-Stranded RNA Oligonucleotides

Oligonucleotide Synthesis and Purification

DsiRNA molecules can be designed to interact with various sites in the RNA message, for example, target sequences within the RNA sequences described herein. In presently exemplified agents, two target KRAS sequences were selected. The sequence of one strand of the DsiRNA molecules were complementary to the target KRAS site sequences described above. The DsiRNA molecules were chemically synthesized using methods described herein. Generally, DsiRNA constructs were synthesized using solid phase oligonucleotide synthesis methods as described for 19-23mer siRNAs (see for example Usman et al., U.S. Pat. Nos. 5,804,683; 5,831,071; 5,998,203; 6,117,657; 6,353,098; 6,362,323; 6,437,117; 6,469,158; Scaringe et al., U.S. Pat. Nos. 6,111,086; 6,008,400; 6,111,086).

Individual RNA strands were synthesized and HPLC purified according to standard methods (Integrated DNA Technologies, Coralville, Iowa). For example, RNA oligonucleotides were synthesized using solid phase phosphoramidite chemistry, deprotected and desalted on NAP-5 columns (Amersham Pharmacia Biotech, Piscataway, N.J.) using standard techniques (Damha and Olgivie, 1993, *Methods Mol Biol* 20: 81-114; Wincott et al., 1995, *Nucleic Acids Res* 23: 2677-84). The oligomers were purified using ion-exchange high performance liquid chromatography (IE-HPLC) on an Amersham Source 15Q column (1.0 cm×25 cm; Amersham Pharmacia Biotech, Piscataway, N.J.) using a 15 min step-linear gradient. The gradient varies from 90:10 Buffers A:B to 52:48 Buffers A:B, where Buffer A is 100 mM Tris pH 8.5 and Buffer B is 100 mM Tris pH 8.5, 1 M NaCl. Samples were monitored at 260 nm and peaks corresponding to the full-length oligonucleotide species are collected, pooled, desalted on NAP-5 columns, and lyophilized.

The purity of each oligomer was determined by capillary electrophoresis (CE) on a Beckman PACE 5000 (Beckman Coulter, Inc., Fullerton, Calif.). The CE capillaries had a 100 µm inner diameter and contains ssDNA 100R Gel (Beckman-Coulter). Typically, about 0.6 nmole of oligonucleotide was injected into a capillary, run in an electric field of 444 V/cm and detected by UV absorbance at 260 nm. Denaturing Tris-Borate-7 M-urea running buffer was purchased from Beckman-Coulter. Oligoribonucleotides were obtained that are at least 90% pure as assessed by CE for use in experiments described below. Compound identity was verified by matrix-assisted laser desorption ionization time-of-flight (MALDI-TOF) mass spectroscopy on a Voyager DE™ Biospectometry Work Station (Applied Biosystems, Foster City, Calif.) following the manufacturer's recommended protocol. Relative molecular masses of all oligomers were obtained, often within 0.2% of expected molecular mass.

Preparation of Duplexes

Single-stranded RNA (ssRNA) oligomers were resuspended, e.g., at 100 µM concentration in duplex buffer consisting of 100 mM potassium acetate, 30 mM HEPES, pH 7.5. Complementary sense and antisense strands were mixed in equal molar amounts to yield a final solution of, e.g., 50 µM duplex. Samples were heated to 100° C. for 5' in RNA buffer (IDT) and allowed to cool to room temperature before use. Double-stranded RNA (dsRNA) oligomers were stored at −20° C. Single-stranded RNA oligomers were stored lyophilized or in nuclease-free water at −80° C.

Nomenclature

For consistency, the following nomenclature has been employed in the instant specification. Names given to duplexes indicate the length of the oligomers and the presence or absence of overhangs. A "25/27" is an asymmetric duplex having a 25 base sense strand and a 27 base antisense strand with a 2-base 3'-overhang. A "27/25" is an asymmetric duplex having a 27 base sense strand and a 25 base antisense strand.

Cell Culture and RNA Transfection

HeLa cells were obtained from ATCC and maintained in Dulbecco's modified Eagle medium (HyClone) supplemented with 10% fetal bovine serum (HyClone) at 37° C. under 5% $CO_2$. For RNA transfections, HeLa cells were transfected with DsiRNAs as indicated at a final concentration of 1 nM or 0.1 nM using Lipofectamine™ RNAiMAX (Invitrogen) and following manufacturer's instructions. Briefly, 2.5 µL of a 0.2 µM or 0.02 µM stock solution of each DsiRNA were mixed with 46.5 µL of Opti-MEM I (Invitrogen) and 1 µL of Lipofectamine™ RNAiMAX. The resulting 50 µL mix was added into individual wells of 12 well plates and incubated for 20 min at RT to allow DsiRNA:Lipofectamine™ RNAiMAX complexes to form. Meanwhile, HeLa cells were trypsinized and resuspended in medium at a final concentration of 367 cells/µL. Finally, 450 µL of the cell suspension were added to each well (final volume 500 µL) and plates were placed into the incubator for 24 hours.

Assessment of KRAS Inhibition

KRAS target gene knockdown was determined by qRT-PCR, with values normalized to HPRT expression control treatments, including Lipofectamine™ RNAiMAX alone (Vehicle control) or untreated.

RNA Isolation and Analysis

Cells were washed once with 2 mL of PBS, and total RNA was extracted using RNeasy Mini Kit™ (Qiagen) and eluted in a final volume of 30 µL. 1 µg of total RNA was reverse-transcribed using Transcriptor 1$^{st}$ Strand cDNA Kit™ (Roche) and random hexamers following manufacturer's instructions. One-thirtieth (0.66 µL) of the resulting cDNA was mixed with 5 µL of IQ Multiplex Powermix (Bio-Rad) together with 3.33 µL of $H_2O$ and 1 µL of a 3 µM mix containing primers and probes specific for human genes HPRT-1 (accession number NM_000194) and KRAS target sequences.

Quantitative RT-PCR

A CFX96 Real-time System with a C1000 Thermal cycler (Bio-Rad) was used for the amplification reactions. PCR conditions were: 95° C. for 3 min; and then cycling at 95° C., 10 sec; 55° C., 1 min for 40 cycles. Each sample was tested in triplicate. Relative HPRT mRNA levels were normalized to KRAS mRNA levels and compared with mRNA levels obtained in control samples treated with the transfection reagent alone, or untreated. Data was analyzed using Bio-Rad CFX Manager version 1.0 software.

Example 3

KRAS-355 Targeted DsiRNA Inhibition of KRAS

DsiRNA molecules targeting KRAS were designed and synthesized as described above and tested in HeLa cells for inhibitory efficacy. The ability of DsiRNA agents possessing varying end structures but commonly directed against the same KRAS cDNA target sequence (5'-AGCAGGTCAA-GAGGAGTACAGTGCAAT-3' (SEQ ID NO: 147)) to inhibit KRAS expression was assessed in comparison to corresponding KRAS target sequence-directed 21mer siRNAs (refer to FIG. 1 for anti-KRAS agent structures tested). To perform such experiments, HeLa cells were plated approximately 24 hours before transfection in 96-well plates at 5,000-7,500 cells/well, 100 µl/well, such that at the time of transfection cells were 70-90% confluent. For transfection, annealed DsiRNAs were mixed with the transfection reagent (Lipofectamine™ RNAiMAX, Invitrogen) in a volume of 50 µl/well and incubated for 20 minutes at room temperature. The DsiRNA transfection mixtures were added to cells to give a final DsiRNA concentration of 1 nM (FIG. 2) or 100 pM (FIG. 3) in a volume of 150 µl. Each DsiRNA transfection mixture was added to 3 wells for triplicate DsiRNA treatments. Cells were incubated at 37° C. for 24 hours in the continued presence of the DsiRNA transfection mixture. At 24 hours, RNA was prepared from each well of treated cells. The supernatants with the transfection mixtures were first removed and discarded, then the cells were lysed and RNA prepared from each well. Target KRAS RNA levels following treatment were evaluated by qRT-PCR for the KRAS target gene, with values normalized to those obtained for a vehicle-treated control. Triplicate data was averaged and the standard deviations determined for each treatment. Normalized data were graphed and the fold reduction of target mRNA by active DsiRNAs in comparison to siRNAs and vehicle or untreated controls was determined.

Figure 2:
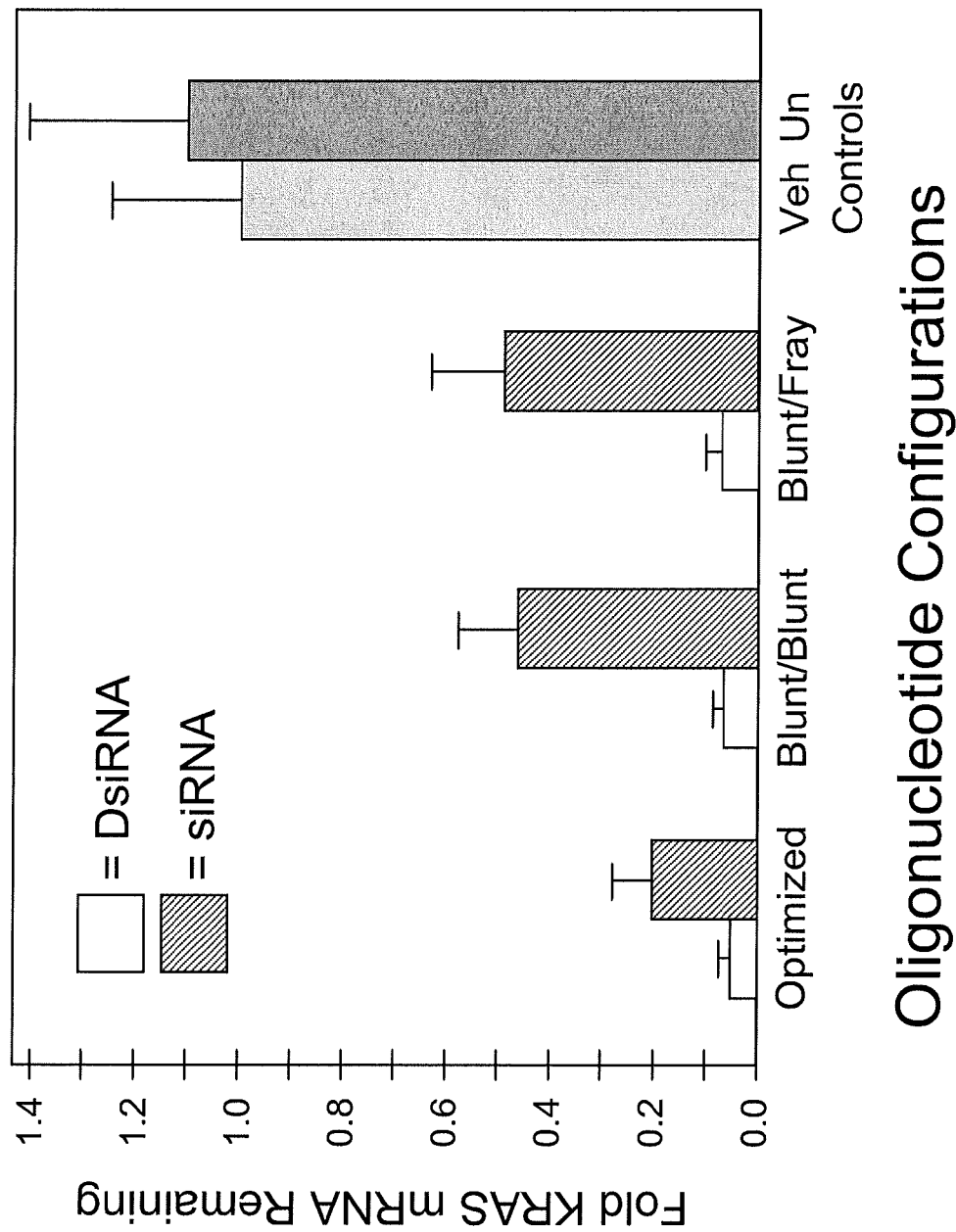
FIG. 2 shows the anti-KRAS inhibitory efficacy of the agents depicted in FIG. 1, when transformed into cells in culture at 1 nanomolar concentration. "Optimized"=25/

As shown in FIG. 2, the tested 25/27mer DsiRNA agent (DP1148P/DP1151G) showed significantly greater KRAS inhibitory efficacy at 1 nM concentration than an optimized 21 mer siRNA (DP1158P/DP1159G siRNA) directed against the same KRAS target sequence and sharing the same projected Ago2 cleavage site within the target KRAS transcript sequence as all other agents of FIG. 1 that were tested (such Ago2 cleavage site alignment normalizes for variations that might otherwise be attributable to varying levels of RISC activity). Notably, Dicer enzyme cleavage of the tested 25/27mer DsiRNA was projected to generate the exact same "optimized" 21mer siRNA as the "optimized" 21mer tested, with the results obtained emphasizing that DsiRNA agents possess special efficacy/potency advantages over corresponding siRNA agents. Similarly dramatic results at 1 nM concentration were observed for both 27mer blunt/blunt and 27mer blunt/fray DsiRNA agents directed against the KRAS-355 sequence, as compared to 21mer siRNAs possessing blunt/blunt and blunt/fray end structures which were similarly directed against the KRAS-355 sequence. Thus, the 25/27mer and 27mer DsiRNAs tested reproducibly exhibited enhanced inhibitory efficacy against the targeted KRAS transcript as compared to the corresponding 21mer agents concurrently tested. Indeed, all 25/27mer and 27mer DsiRNAs tested at 1 nM concentration surprisingly outperformed all 21mer siRNAs tested at the same concentration.

Robust inhibitory efficacies were also observed for the anti-KRAS-355 DsiRNA agents at 100 pM concentration (FIG. 3). The tested 25/27mer DsiRNA agent (DP1148P/DP1151G) showed significantly greater KRAS inhibitory efficacy at 100 pM concentration than the optimized 21mer siRNA (DP1158P/DP1159G siRNA) directed against the same KRAS-355 target sequence. Similarly dramatic results at 100 pM concentration were observed for 27mer blunt/fray DsiRNA agents directed against the KRAS-355 sequence, as compared to the corresponding 21 mer siRNA possessing blunt/fray end structures. The 27mer blunt/blunt agent was at least equally as effective as the corresponding 21 mer blunt/blunt agent that was tested, even if the apparent enhancement of 27mer blunt/blunt agent efficacy relative to 21 mer blunt/blunt agent efficacy was not statistically significant at 100 pM concentration. Thus, the 25/27mer and 27mer blunt/fray DsiRNAs tested reproducibly exhibited enhanced inhibitory efficacy against the targeted KRAS transcript as compared to the corresponding 21mer siRNA agents concurrently tested at 100 pM.

Example 4

KRAS-940 Targeted DsiRNA Inhibition of KRAS

DsiRNA molecules targeting KRAS were designed and synthesized as described above and tested in HeLa cells for inhibitory efficacy as described in Example 3. The ability of DsiRNA agents possessing varying end structures but commonly directed against the same KRAS cDNA target sequence (5'-TATTAGCATTTTGITTTAGCATTACCTA-3' (SEQ ID NO: 179)) to inhibit KRAS expression was assessed in comparison to corresponding KRAS target sequence-directed 21mer siRNAs (refer to FIG. 4 for anti-KRAS agent structures tested). As shown in FIG. 5, the tested 25/27mer DsiRNA agent (DP1136P/DP1139G) showed significantly greater KRAS inhibitory efficacy at 1 nM concentration than an optimized 21mer siRNA (DP1146P/DP1147G siRNA) directed against the same KRAS target sequence and sharing the same projected Ago2 cleavage site within the target KRAS transcript sequence as all other agents of FIG. 4 that were tested (such Ago2 cleavage site alignment normalizes for variations that might otherwise be attributable to varying levels of RISC activity). Notably, Dicer enzyme cleavage of the tested 25/27mer DsiRNA was projected to generate the exact same "optimized" 21mer siRNA as the "optimized" 21mer tested, with the results obtained emphasizing that DsiRNA agents possess special efficacy/potency advantages over corresponding siRNA agents. Similarly dramatic results at 1 nM concentration were observed for both 27mer blunt/blunt and 27mer blunt/fray DsiRNA agents directed against the KRAS-940 sequence, as compared to 21mer siRNAs possessing blunt/blunt and blunt/fray end structures which were similarly directed against the KRAS-940 sequence. Thus, the 25/27mer and 27mer DsiRNAs tested reproducibly exhibited enhanced inhibitory efficacy against the targeted KRAS transcript as compared to the corresponding 21mer agents concurrently tested. Indeed, all 25/27mer and 27mer DsiRNAs tested at 1 nM concentration unexpectedly outperformed all 21 mer siRNAs tested at the same concentration.

Robust inhibitory efficacies were also observed for the anti-KRAS-940 DsiRNA agents at 100 pM concentration (FIG. 6). The tested 25/27mer DsiRNA agent (DP1136P/DP1139G) showed significantly greater KRAS inhibitory efficacy at 100 pM concentration than the optimized 21mer siRNA (DP1146P/DP1147G siRNA) directed against the same KRAS-940 target sequence. Similarly dramatic results at 100 pM concentration were observed for 27mer blunt/blunt and blunt/fray DsiRNA agents directed against the KRAS-940 sequence, as compared to the corresponding 21mer siRNAs possessing blunt/blunt and blunt/fray end structures. Thus, the 25/27mer and 27mer blunt/blunt and blunt/fray DsiRNAs tested reproducibly exhibited enhanced inhibitory efficacy against the targeted KRAS transcript as compared to the corresponding 21mer siRNA agents concurrently tested at 100 pM. Indeed, all anti-KRAS-940 25/27mer and 27mer DsiRNAs tested at 100 pM concentration unexpectedly outperformed all 21mer siRNAs which were tested at the same concentration.

Example 5

Further DsiRNA Inhibition of KRAS

The forty DsiRNA molecules shown in Table 3 possessing antisense strand SEQ ID NOs: 11-50 and targeting KRAS wild-type sequences (the DsiRNAs of Table 3 targeting alternative/polymorphic sequences were not tested) were designed and synthesized as described above and tested in HeLa cells for inhibitory efficacy as described in Example 3 above. The ability of these DsiRNA agents to inhibit KRAS expression was assessed in comparison to corresponding KRAS target sequence-directed 21 mer siRNAs (refer to Table 2 for corresponding anti-KRAS 21mer agent antisense strands tested, and to FIG. 7 for a schematic representation of the experiment). All DsiRNA agents showed efficacy as KRAS inhibitors, with 35 of 40 tested DsiRNA agents exhibiting greater than 50% reduction of the KRAS target. As shown in FIG. 8, for four out of every five DsiRNA-cognate siRNA pairs tested, the DsiRNA agent exhibited significantly superior efficacy in decreasing levels of KRAS target than the cognate siRNA agent. The duration of such inhibitory effects was also examined at both 24 hours and 48 hours post-administration, with concentrations of 1 nM and 5 nM tested. For 26 of the 40 DsiRNA-cognate siRNA pairs, the DsiRNA agent showed statistically significant enhanced levels of KRAS target inhibition than the corresponding cognate siRNA agent at all concentrations and durations tested (FIG. 9). This result was in marked contrast to the only 6 of 40 instances in which the cognate siRNA agent outperformed the DsiRNA agent (FIG. 9). Thus, statistically significant distinctions were observed between DsiRNAs and matched cognate siRNAs (possessing aligned projected Agog cleavage sites) across the KRAS target RNA. By a large majority, the DsiRNAs dramatically and unexpectedly outperformed cognate siRNAs. Importantly, these results demonstrated that DsiRNA activity did not directly correlate with siRNA activity, nor did the converse hold. Accordingly, the above results demonstrated that DsiRNAs and siRNAs engage the RNA interference machinery differently, and that DsiRNAs and siRNAs—in spite of both comprising double-stranded RNA—are, in fact, different drugs.

As shown in FIGS. 10 and 11, $IC_{50}$ values were determined for 29 of these 40 KRAS-targeting asymmetric DsiRNAs. Remarkably, 15 of these 29 asymmetric DsiRNAs exhibited $IC_{50}$ values below 10 pM, further documenting the remarkable potency of these DsiRNAs.

Example 6

Assay of 243 Selected KRAS-Targeting DsiRNAs for KRAS Inhibition

In this example, 243 asymmetric DsiRNAs (here, as above, tested DsiRNAs possessed a 25/27mer structure) were constructed and tested for KRAS inhibitory efficacy in human HeLa and mouse Hepa 1-6 cells incubated in the presence of such DsiRNAs at a concentration of 1 nM. The 243 asymmetric DsiRNAs tested included a subset of DsiRNAs selected from Tables 2-5 above, as well as a further set of asymmetric DsiRNAs designed to target specific sequences within human KRAS, mouse KRAS, or both. Sequences and structures of these additional 243 asymmetric DsiRNAs are shown in Table 8.

TABLE 8

Additional Anti-KRAS Asymmetric (25/27 mer) DsiRNA Agent Structures Tested in Human HeLa and Mouse Hepa 1-6 Cells

```
5'-GAGGCCUGCUGAAAAUGACUGAAta-3'        (SEQ ID NO: 4650)
3'-CUCUCCGGACGACUUUUACUGACUUAU-5'      (SEQ ID NO: 4407)

KRAS-166 Target:
5'-GAGAGGCCTGCTGAAAATGACTGAATA-3'      (SEQ ID NO: 4893)

5'-AGGCCUGCUGAAAAUGACUGAAUat-3'      (SEQ ID NO: 4651)
3'-UCUCCGGACGACUUUUACUGACUUAUA-5'      (SEQ ID NO: 4408)

KRAS-167 Target:
5'-AGAGGCCTGCTGAAAATGACTGAATAT-3'      (SEQ ID NO: 4894)

5'-GGCCUGCUGAAAAUGACUGAAUAta-3'      (SEQ ID NO: 4652)
3'-CUCCGGACGACUUUUACUGACUUAUAU-5'      (SEQ ID NO: 4409)

KRAS-168 Target:
5'-GAGGCCTGCTGAAAATGACTGAATATA-3'      (SEQ ID NO: 4895)

5'-GCCUGCUGAAAAUGACUGAAUAUaa-3'      (SEQ ID NO: 4653)
3'-UCCGGACGACUUUUACUGACUUAUAUU-5'      (SEQ ID NO: 4410)

KRAS-169 Target:
5'-AGGCCTGCTGAAAATGACTGAATATAA-3'      (SEQ ID NO: 4896)

5'-GUUGGAGCUGGUGGCGUAGGCAAga-3'      (SEQ ID NO: 4654)
3'-AUCAACCUCGACCACCGCAUCCGUUCU-5'      (SEQ ID NO: 4411)

KRAS-204 Target:
5'-TAGTTGGAGCTGGTGGCGTAGGCAAGA-3'      (SEQ ID NO: 4897)

5'-UUGGAGCUGGUGGCGUAGGCAAGag-3'      (SEQ ID NO: 4655)
3'-UCAACCUCGACCACCGCAUCCGUUCUC-5'      (SEQ ID NO: 4412)

KRAS-205 Target:
5'-AGTTGGAGCTGGTGGCGTAGGCAAGAG-3'      (SEQ ID NO: 4898)

5'-UGGAGCUGGUGGCGUAGGCAAGAgt-3'      (SEQ ID NO: 4656)
3'-CAACCUCGACCACCGCAUCCGUUCUCA-5'      (SEQ ID NO: 4413)

KRAS-206 Target:
5'-GTTGGAGCTGGTGGCGTAGGCAAGAGT-3'      (SEQ ID NO: 4899)

5'-GGAGCUGGUGGCGUAGGCAAGAGtg-3'      (SEQ ID NO: 4657)
3'-AACCUCGACCACCGCAUCCGUUCUCAC-5'      (SEQ ID NO: 4414)

KRAS-207 Target:
5'-TTGGAGCTGGTGGCGTAGGCAAGAGTG-3'      (SEQ ID NO: 4900)

5'-GAGCUGGUGGCGUAGGCAAGAGUgc-3'      (SEQ ID NO: 4658)
3'-ACCUCGACCACCGCAUCCGUUCUCACG-5'      (SEQ ID NO: 4415)

KRAS-208 Target:
5'-TGGAGCTGGTGGCGTAGGCAAGAGTGC-3'      (SEQ ID NO: 4901)

5'-AGCUGGUGGCGUAGGCAAGAGUGcc-3'      (SEQ ID NO: 4659)
3'-CCUCGACCACCGCAUCCGUUCUCACGG-5'      (SEQ ID NO: 4416)

KRAS-209 Target:
5'-GGAGCTGGTGGCGTAGGCAAGAGTGCC-3'      (SEQ ID NO: 4902)

5'-GCUGGUGGCGUAGGCAAGAGUGCct-3'      (SEQ ID NO: 4660)
3'-CUCGACCACCGCAUCCGUUCUCACGGA-5'      (SEQ ID NO: 4417)

KRAS-210 Target:
5'-GAGCTGGTGGCGTAGGCAAGAGTGCCT-3'      (SEQ ID NO: 4903)

5'-UACAGCUAAUUCAGAAUCAUUUUgt-3'      (SEQ ID NO: 4661)
3'-CUAUGUCGAUUAAGUCUUAGUAAAACA-5'      (SEQ ID NO: 4418)

KRAS-241 Target:
5'-GATACAGCTAATTCAGAATCATTTTGT-3'      (SEQ ID NO: 4904)

5'-UAAUUGAUGGAGAAACCUGUCUCtt-3'      (SEQ ID NO: 4662)
3'-UCAUUAACUACCUCUUUGGACAGAGAA-5'      (SEQ ID NO: 4419)
```

TABLE 8-continued

Additional Anti-KRAS Asymmetric (25/27 mer) DsiRNA
Agent Structures Tested in Human HeLa and Mouse
Hepa 1-6 Cells KRAS-313 Target:
5'-AGTAATTGATGGAGAAACCTGTCTCTT-3'  (SEQ ID NO: 4905)

5'-AAUUGAUGGAGAAACCUGUCUCUtg-3'  (SEQ ID NO: 4663)
3'-CAUUAACUACCUCUUUGGACAGAGAAC-5'  (SEQ ID NO: 4420)

KRAS-314 Target:
5'-GTAATTGATGGAGAAACCTGTCTCTTG-3'  (SEQ ID NO: 4906)

5'-GAUGGAGAAACCUGUCUCUUGGAta-3'  (SEQ ID NO: 4664)
3'-AACUACCUCUUUGGACAGAGAACCUAU-5'  (SEQ ID NO: 4421)

KRAS-318 Target:
5'-TTGATGGAGAAACCTGTCTCTTGGATA-3'  (SEQ ID NO: 4907)

5'-CCUGUCUCUUGGAUAUUCUCGACac-3'  (SEQ ID NO: 4665)
3'-UUGGACAGAGAACCUAUAAGAGCUGUG-5'  (SEQ ID NO: 4422)

KRAS-328 Target:
5'-AACCTGTCTCTTGGATATTCTCGACAC-3'  (SEQ ID NO: 4908)

5'-UGUCUCUUGGAUAUUCUCGACACag-3'  (SEQ ID NO: 4666)
3'-GGACAGAGAACCUAUAAGAGCUGUGUC-5'  (SEQ ID NO: 4423)

KRAS-330 Target:
5'-CCTGTCTCTTGGATATTCTCGACACAG-3'  (SEQ ID NO: 4909)

5'-GUCUCUUGGAUAUUCUCGACACAgc-3'  (SEQ ID NO: 4667)
3'-GACAGAGAACCUAUAAGAGCUGUGUCG-5'  (SEQ ID NO: 4424)

KRAS-331 Target:
5'-CTGTCTCTTGGATATTCTCGACACAGC-3'  (SEQ ID NO: 4910)

5'-UCUCUUGGAUAUUCUCGACACAGca-3'  (SEQ ID NO: 4668)
3'-ACAGAGAACCUAUAAGAGCUGUGUCGU-5'  (SEQ ID NO: 4425)

KRAS-332 Target:
5'-TGTCTCTTGGATATTCTCGACACAGCA-3'  (SEQ ID NO: 4911)

5'-CUCUUGGAUAUUCUCGACACAGCag-3'  (SEQ ID NO: 4669)
3'-CAGAGAACCUAUAAGAGCUGUGUCGUC-5'  (SEQ ID NO: 4426)

KRAS-333 Target:
5'-GTCTCTTGGATATTCTCGACACAGCAG-3'  (SEQ ID NO: 4912)

5'-UCUUGGAUAUUCUCGACACAGCAgg-3'  (SEQ ID NO: 4670)
3'-AGAGAACCUAUAAGAGCUGUGUCGUCC-5'  (SEQ ID NO: 4427)

KRAS-334 Target:
5'-TCTCTTGGATATTCTCGACACAGCAGG-3'  (SEQ ID NO: 4913)

5'-CUUGGAUAUUCUCGACACAGCAGgt-3'  (SEQ ID NO: 4671)
3'-GAGAACCUAUAAGAGCUGUGUCGUCCA-5'  (SEQ ID NO: 4428)

KRAS-335 Target:
5'-CTCTTGGATATTCTCGACACAGCAGGT-3'  (SEQ ID NO: 4914)

5'-UUGGAUAUUCUCGACACAGCAGGtc-3'  (SEQ ID NO: 4672)
3'-AGAACCUAUAAGAGCUGUGUCGUCCAG-5'  (SEQ ID NO: 4429)

KRAS-336 Target:
5'-TCTTGGATATTCTCGACACAGCAGGTC-3'  (SEQ ID NO: 4915)

5'-CAGCAGGUCAAGAGGAGUACAGUgc-3'  (SEQ ID NO: 4673)
3'-GUGUCGUCCAGUUCUCCUCAUGUCACG-5'  (SEQ ID NO: 4430)

KRAS-352 Target:
5'-CACAGCAGGTCAAGAGGAGTACAGTGC-3'  (SEQ ID NO: 4916)

5'-AGCAGGUCAAGAGGAGUACAGUGca-3'  (SEQ ID NO: 4674)
3'-UGUCGUCCAGUUCUCCUCAUGUCACGU-5'  (SEQ ID NO: 4431)

KRAS-353 Target:
5'-ACAGCAGGTCAAGAGGAGTACAGTGCA-3'  (SEQ ID NO: 4917)

TABLE 8-continued

Additional Anti-KRAS Asymmetric (25/27 mer) DsiRNA
Agent Structures Tested in Human HeLa and Mouse
Hepa 1-6 Cells

```
5'-GCAGGUCAAGAGGAGUACAGUGCaa-3'      (SEQ ID NO: 4675)
3'-GUCGUCCAGUUCUCCUCAUGUCACGUU-5'    (SEQ ID NO: 4432)

KRAS-354 Target:
5'-CAGCAGGTCAAGAGGAGTACAGTGCAA-3'    (SEQ ID NO: 4918)

5'-AGGAGUACAGUGCAAUGAGGGACCa-3'    (SEQ ID NO: 4676)
3'-UCUCCUCAUGUCACGUUACUCCCUGGU-5'    (SEQ ID NO: 4433)

KRAS-364 Target:
5'-AGAGGAGTACAGTGCAATGAGGGACCA-3'    (SEQ ID NO: 4919)

5'-GGAGUACAGUGCAAUGAGGGACCag-3'    (SEQ ID NO: 4677)
3'-CUCCUCAUGUCACGUUACUCCCUGGUC-5'    (SEQ ID NO: 4434)

KRAS-365 Target:
5'-GAGGAGTACAGTGCAATGAGGGACCAG-3'    (SEQ ID NO: 4920)

5'-GAGUACAGUGCAAUGAGGGACCAgt-3'    (SEQ ID NO: 4678)
3'-UCCUCAUGUCACGUUACUCCCUGGUCA-5'    (SEQ ID NO: 4435)

KRAS-366 Target:
5'-AGGAGTACAGTGCAATGAGGGACCAGT-3'    (SEQ ID NO: 4921)

5'-AGUACAGUGCAAUGAGGGACCAGta-3'    (SEQ ID NO: 4679)
3'-CCUCAUGUCACGUUACUCCCUGGUCAU-5'    (SEQ ID NO: 4436)

KRAS-367 Target:
5'-GGAGTACAGTGCAATGAGGGACCAGTA-3'    (SEQ ID NO: 4922)

5'-GUACAGUGCAAUGAGGGACCAGUac-3'    (SEQ ID NO: 4680)
3'-CUCAUGUCACGUUACUCCCUGGUCAUG-5'    (SEQ ID NO: 4437)

KRAS-368 Target:
5'-GAGTACAGTGCAATGAGGGACCAGTAC-3'    (SEQ ID NO: 4923)

5'-UACAGUGCAAUGAGGGACCAGUAca-3'    (SEQ ID NO: 4681)
3'-UCAUGUCACGUUACUCCCUGGUCAUGU-5'    (SEQ ID NO: 4438)

KRAS-369 Target:
5'-AGTACAGTGCAATGAGGGACCAGTACA-3'    (SEQ ID NO: 4924)

5'-ACAGUGCAAUGAGGGACCAGUACat-3'    (SEQ ID NO: 4682)
3'-CAUGUCACGUUACUCCCUGGUCAUGUA-5'    (SEQ ID NO: 4439)

KRAS-370 Target:
5'-GTACAGTGCAATGAGGGACCAGTACAT-3'    (SEQ ID NO: 4925)

5'-CAGUGCAAUGAGGGACCAGUACAtg-3'    (SEQ ID NO: 4683)
3'-AUGUCACGUUACUCCCUGGUCAUGUAC-5'    (SEQ ID NO: 4440)

KRAS-371 Target:
5'-TACAGTGCAATGAGGGACCAGTACATG-3'    (SEQ ID NO: 4926)

5'-AGUGCAAUGAGGGACCAGUACAUga-3'    (SEQ ID NO: 4684)
3'-UGUCACGUUACUCCCUGGUCAUGUACU-5'    (SEQ ID NO: 4441)

KRAS-372 Target:
5'-ACAGTGCAATGAGGGACCAGTACATGA-3'    (SEQ ID NO: 4927)

5'-GUAUUUGCCAUAAAUAAUACUAAat-3'    (SEQ ID NO: 4685)
3'-CACAUAAACGGUAUUUAUUAUGAUUUA-5'    (SEQ ID NO: 4442)

KRAS-420 Target:
5'-GTGTATTTGCCATAAATAATACTAAAT-3'    (SEQ ID NO: 4928)

5'-UAUUUGCCAUAAAUAAUACUAAAtc-3'    (SEQ ID NO: 4686)
3'-ACAUAAACGGUAUUUAUUAUGAUUUAG-5'    (SEQ ID NO: 4443)

KRAS-421 Target:
5'-TGTATTTGCCATAAATAATACTAAATC-3'    (SEQ ID NO: 4929)

5'-AUUUGCCAUAAAUAAUACUAAAUca-3'    (SEQ ID NO: 4687)
3'-CAUAAACGGUAUUUAUUAUGAUUUAGU-5'    (SEQ ID NO: 4444)
```

TABLE 8-continued

Additional Anti-KRAS Asymmetric (25/27 mer) DsiRNA
Agent Structures Tested in Human HeLa and Mouse
Hepa 1-6 Cells

```
KRAS-422 Target:
5'-GTATTTGCCATAAATAATACTAAATCA-3'        (SEQ ID NO: 4930)

5'-UUUGCCAUAAAUAAUACUAAAUCat-3'      (SEQ ID NO: 4688)
 3'-AUAAACGGUAUUUAUUAUGAUUUAGUA-5'       (SEQ ID NO: 4445)

KRAS-423 Target:
5'-TATTTGCCATAAATAATACTAAATCAT-3'        (SEQ ID NO: 4931)

5'-UUGCCAUAAAUAAUACUAAAUCAtt-3'      (SEQ ID NO: 4689)
 3'-UAAACGGUAUUUAUUAUGAUUUAGUAA-5'       (SEQ ID NO: 4446)

KRAS-424 Target:
5'-ATTTGCCATAAATAATACTAAATCATT-3'        (SEQ ID NO: 4932)

5'-UGCCAUAAAUAAUACUAAAUCAUtt-3'      (SEQ ID NO: 4690)
 3'-AAACGGUAUUUAUUAUGAUUUAGUAAA-5'       (SEQ ID NO: 4447)

KRAS-425 Target:
5'-TTTGCCATAAATAATACTAAATCATTT-3'        (SEQ ID NO: 4933)

5'-GCCAUAAAUAAUACUAAAUCAUUtg-3'      (SEQ ID NO: 4691)
 3'-AACGGUAUUUAUUAUGAUUUAGUAAAC-5'       (SEQ ID NO: 4448)

KRAS-426 Target:
5'-TTGCCATAAATAATACTAAATCATTTG-3'        (SEQ ID NO: 4934)

5'-AUACUAAAUCAUUUGAAGAUAUUca-3'      (SEQ ID NO: 4692)
 3'-AUUAUGAUUUAGUAAACUUCUAUAAGU-5'       (SEQ ID NO: 4449)

KRAS-436 Target:
5'-TAATACTAAATCATTTGAAGATATTCA-3'        (SEQ ID NO: 4935)

5'-UACUAAAUCAUUUGAAGAUAUUCac-3'      (SEQ ID NO: 4693)
 3'-UUAUGAUUUAGUAAACUUCUAUAAGUG-5'       (SEQ ID NO: 4450)

KRAS-437 Target:
5'-AATACTAAATCATTTGAAGATATTCAC-3'        (SEQ ID NO: 4936)

5'-ACUAAAUCAUUUGAAGAUAUUCAcc-3'      (SEQ ID NO: 4694)
 3'-UAUGAUUUAGUAAACUUCUAUAAGUGG-5'       (SEQ ID NO: 4451)

KRAS-438 Target:
5'-ATACTAAATCATTTGAAGATATTCACC-3'        (SEQ ID NO: 4937)

5'-CUAAAUCAUUUGAAGAUAUUCACca-3'      (SEQ ID NO: 4695)
 3'-AUGAUUUAGUAAACUUCUAUAAGUGGU-5'       (SEQ ID NO: 4452)

KRAS-439 Target:
5'-TACTAAATCATTTGAAGATATTCACCA-3'        (SEQ ID NO: 4938)

5'-UAAAUCAUUUGAAGAUAUUCACCat-3'      (SEQ ID NO: 4696)
 3'-UGAUUUAGUAAACUUCUAUAAGUGGUA-5'       (SEQ ID NO: 4453)

KRAS-440 Target:
5'-ACTAAATCATTTGAAGATATTCACCAT-3'        (SEQ ID NO: 4939)

5'-AAAUCAUUUGAAGAUAUUCACCAtt-3'      (SEQ ID NO: 4697)
 3'-GAUUUAGUAAACUUCUAUAAGUGGUAA-5'       (SEQ ID NO: 4454)

KRAS-441 Target:
5'-CTAAATCATTTGAAGATATTCACCATT-3'        (SEQ ID NO: 4940)

5'-AAUCAUUUGAAGAUAUUCACCAUta-3'      (SEQ ID NO: 4698)
 3'-AUUUAGUAAACUUCUAUAAGUGGUAAU-5'       (SEQ ID NO: 4455)

KRAS-442 Target:
5'-TAAATCATTTGAAGATATTCACCATTA-3'        {SEQ ID NO: 4941)

5'-AUCAUUUGAAGAUAUUCACCAUUat-3'      (SEQ ID NO: 4699)
 3'-UUUAGUAAACUUCUAUAAGUGGUAAUA-5'       (SEQ ID NO: 4456)

KRAS-443 Target:
5'-AAATCATTTGAAGATATTCACCATTAT-3'        (SEQ ID NO: 4942)
```

TABLE 8-continued

Additional Anti-KRAS Asymmetric (25/27 mer) DsiRNA Agent Structures Tested in Human HeLa and Mouse Hepa 1-6 Cells

```
   5'-UCAUUUGAAGAUAUUCACCAUUAta-3'       (SEQ ID NO: 4700)
3'-UUAGUAAACUUCUAUAAGUGGUAAUAU-5'       (SEQ ID NO: 4457)

KRAS-444 Target:
5'-AATCATTTGAAGATATTCACCATTATA-3'       (SEQ ID NO: 4943)

5'-AUAUUCACCAUUAUAGAGAACAAat-3'      (SEQ ID NO: 4701)
3'-UCUAUAAGUGGUAAUAUCUCUUGUUUA-5'       (SEQ ID NO: 4458)

KRAS-454 Target:
5'-AGATATTCACCATTATAGAGAACAAAT-3'       (SEQ ID NO: 4944)

5'-UAUUCACCAUUAUAGAGAACAAAtt-3'      (SEQ ID NO: 4702)
3'-CUAUAAGUGGUAAUAUCUCUUGUUUAA-5'       (SEQ ID NO: 4459)

KRAS-455 Target:
5'-GATATTCACCATTATAGAGAACAAATT-3'       (SEQ ID NO: 4945)

5'-AUUCACCAUUAUAGAGAACAAAUta-3'      (SEQ ID NO: 4703)
3'-UAUAAGUGGUAAUAUCUCUUGUUUAAU-5'       (SEQ ID NO: 4460)

KRAS-456 Target:
5'-ATATTCACCATTATAGAGAACAAATTA-3'       (SEQ ID NO: 4946)

5'-UUCACCAUUAUAGAGAACAAAUUaa-3'      (SEQ ID NO: 4704)
3'-AUAAGUGGUAAUAUCUCUUGUUUAAUU-5'       (SEQ ID NO: 4461)

KRAS-457 Target:
5'-TATTCACCATTATAGAGAACAAATTAA-3'       (SEQ ID NO: 4947)

5'-UCACCAUUAUAGAGAACAAAUUAaa-3'      (SEQ ID NO: 4705)
3'-UAAGUGGUAAUAUCUCUUGUUUAAUUU-5'       (SEQ ID NO: 4462)

KRAS-458 Target:
5'-ATTCACCATTATAGAGAACAAATTAAA-3'       (SEQ ID NO: 4948)

5'-CACCAUUAUAGAGAACAAAUUAAaa-3'      (SEQ ID NO: 4706)
3'-AAGUGGUAAUAUCUCUUGUUUAAUUUU-5'       (SEQ ID NO: 4463)

KRAS-459 Target:
5'-TTCACCATTATAGAGAACAAATTAAAA-3'       (SEQ ID NO: 4949)

5'-ACCAUUAUAGAGAACAAAUUAAAag-3'      (SEQ ID NO: 4707)
3'-AGUGGUAAUAUCUCUUGUUUAAUUUUC-5'       (SEQ ID NO: 4464)

KRAS-460 Target:
5'-TCACCATTATAGAGAACAAATTAAAAG-3'       (SEQ ID NO: 4950)

5'-CCAUUAUAGAGAACAAAUUAAAAga-3'      (SEQ ID NO: 4708)
3'-GUGGUAAUAUCUCUUGUUUAAUUUUCU-5'       (SEQ ID NO: 4465)

KRAS-461 Target:
5'-CACCATTATAGAGAACAAATTAAAAGA-3'       (SEQ ID NO: 4951)

5'-CAUUAUAGAGAACAAAUUAAAAGag-3'      (SEQ ID NO: 4709)
3'-UGGUAAUAUCUCUUGUUUAAUUUUCUC-5'       (SEQ ID NO: 4466)

KRAS-462 Target:
5'-ACCATTATAGAGAACAAATTAAAAGAG-3'       (SEQ ID NO: 4952)

5'-CUAUGGUCCUAGUAGGAAAUAAAtg-3'      (SEQ ID NO: 4710)
3'-UGGAUACCAGGAUCAUCCUUUAUUUAC-5'       (SEQ ID NO: 4467)

KRAS-508 Target:
5'-ACCTATGGTCCTAGTAGGAAATAAATG-3'       (SEQ ID NO: 4953)

5'-UGUGAUUUGCCUUCUAGAACAGUag-3'      (SEQ ID NO: 4711)
3'-UUACACUAAACGGAAGAUCUUGUCAUC-5'       (SEQ ID NO: 4468)

KRAS-531 Target:
5'-AATGTGATTTGCCTTCTAGAACAGTAG-3'       (SEQ ID NO: 4954)

5'-GUGAUUUGCCUUCUAGAACAGUAga-3'      (SEQ ID NO: 4712)
3'-UACACUAAACGGAAGAUCUUGUCAUCU-5'       (SEQ ID NO: 4469)
```

TABLE 8-continued

Additional Anti-KRAS Asymmetric (25/27 mer) DsiRNA
Agent Structures Tested in Human HeLa and Mouse
Hepa 1-6 Cells KRAS-532 Target:
5'-ATGTGATTTGCCTTCTAGAACAGTAGA-3'       (SEQ ID NO: 4955)

5'-GAUUUGCCUUCUAGAACAGUAGAca-3'      (SEQ ID NO: 4713)
3'-CACUAAACGGAAGAUCUUGUCAUCUGU-5'      (SEQ ID NO: 4470)

KRAS-534 Target:
5'-GTGATTTGCCTTCTAGAACAGTAGACA-3'       (SEQ ID NO: 4956)

5'-GUUAUGGAAUUCCUUUUAUUGAAac-3'      (SEQ ID NO: 4714)
3'-UUCAAUACCUUAAGGAAAAUAACUUUG-5'      (SEQ ID NO: 4471)

KRAS-586 Target:
5'-AAGTTATGGAATTCCTTTTATTGAAAC-3'       (SEQ ID NO: 4957)

5'-UUAUGGAAUUCCUUUUAUUGAAACa-3'      (SEQ ID NO: 4715)
3'-UCAAUACCUUAAGGAAAAUAACUUUGU-5'      (SEQ ID NO: 4472)

KRAS-587 Target:
5'-AGTTATGGAATTCCTTTTATTGAAACA-3'       (SEQ ID NO: 4958)

5'-UAUGGAAUUCCUUUUAUUGAAACat-3'      (SEQ ID NO: 4716)
3'-CAAUACCUUAAGGAAAAUAACUUUGUA-5'      (SEQ ID NO: 4473)

KRAS-588 Target:
5'-GTTATGGAATTCCTTTTATTGAAACAT-3'       (SEQ ID NO: 4959)

5'-GAUGCCUUCUAUACAUUAGUUCGag-3'      (SEQ ID NO: 4717)
3'-UACUACGGAAGAUAUGUAAUCAAGCUC-5'      (SEQ ID NO: 4474)

KRAS-763 Target:
5'-ATGATGCCTTCTATACATTAGTTCGAG-3'       (SEQ ID NO: 4960)

5'-AUGCCUUCUAUACAUUAGUUCGAga-3'      (SEQ ID NO: 4718)
3'-ACUACGGAAGAUAUGUAAUCAAGCUCU-5'      (SEQ ID NO: 4475)

KRAS-764 Target:
5'-TGATGCCTTCTATACATTAGTTCGAGA-3'       (SEQ ID NO: 4961)

5'-CGAGAAAUUCGAAAACAUAAAGAaa-3'      (SEQ ID NO: 4719)
3'-AAGCUCUUUAAGCUUUUGUAUUUCUUU-5'      (SEQ ID NO: 4476)

KRAS-784 Target:
5'-TTCGAGAAATTCGAAAACATAAAGAAA-3'       (SEQ ID NO: 4962)

5'-GAAAACAUAAAGAAAAGAUGAGCaa-3'      (SEQ ID NO: 4720)
3'-AGCUUUUGUAUUUCUUUUCUACUCGUU-5'      (SEQ ID NO: 4477)

KRAS-794 Target:
5'-TCGAAAACATAAAGAAAGATGAGCAA-3'        (SEQ ID NO: 4963)

5'-AAAACAUAAAGAAAAGAUGAGCAaa-3'      (SEQ ID NO: 4721)
3'-GCUUUUGUAUUUCUUUUCUACUCGUUU-5'      (SEQ ID NO: 4478)

KRAS-795 Target:
5'-CGAAAACATAAAGAAAGATGAGCAAA-3'        (SEQ ID NO: 4964)

5'-AAACAUAAAGAAAAGAUGAGCAAag-3'      (SEQ ID NO: 4722)
3'-CUUUUGUAUUUCUUUUCUACUCGUUUC-5'      (SEQ ID NO: 4479)

KRAS-796 Target:
5'-GAAAACATAAAGAAAGATGAGCAAAG-3'        (SEQ ID NO: 4965)

5'-AACAUAAAGAAAAGAUGAGCAAAga-3'      (SEQ ID NO: 4723)
3'-UUUUGUAUUUCUUUUCUACUCGUUUCU-5'      (SEQ ID NO: 4480)

KRAS-797 Target:
5'-AAAACATAAAGAAAGATGAGCAAAGA-3'        (SEQ ID NO: 4966)

5'-ACAUAAAGAAAAGAUGAGCAAAGat-3'      (SEQ ID NO: 4724)
3'-UUUGUAUUUCUUUUCUACUCGUUUCUA-5'      (SEQ ID NO: 4481)

KRAS-798 Target:
5'-AAACATAAAGAAAGATGAGCAAAGAT-3'        (SEQ ID NO: 4967)

TABLE 8-continued

Additional Anti-KRAS Asymmetric (25/27 mer) DsiRNA Agent Structures Tested in Human HeLa and Mouse Hepa 1-6 Cells

```
5'-CAUAAAGAAAAGAUGAGCAAAGAtg-3'      (SEQ ID NO: 4725)
3'-UUGUAUUUCUUUUCUACUCGUUUCUAC-5'    (SEQ ID.NO: 4482)

KRAS-799 Target:
5'-AACATAAAGAAAAGATGAGCAAAGATG-3'    (SEQ ID NO: 4968)

5'-AUAAAGAAAAGAUGAGCAAAGAUgg-3'    (SEQ ID NO: 4726)
3'-UGUAUUUCUUUUCUACUCGUUUCUACC-5'    (SEQ ID NO: 4483)

KRAS-800 Target:
5'-ACATAAAGAAAAGATGAGCAAAGATGG-3'    (SEQ ID NO: 4969)

5'-UAAAGAAAAGAUGAGCAAAGAUGgt-3'    (SEQ ID NO: 4727)
3'-GUAUUUCUUUUCUACUCGUUUCUACCA-5'    (SEQ ID NO: 4484)

KRAS-801 Target:
5'-CATAAAGAAAAGATGAGCAAAGATGGT-3'    (SEQ ID NO: 4970)

5'-AAAGAAAAGAUGAGCAAAGAUGGta-3'    (SEQ ID NO: 4728)
3'-UAUUUCUUUUCUACUCGUUUCUACCAU-5'    (SEQ ID NO: 4485)

KRAS-802 Target:
5'-ATAAAGAAAAGATGAGCAAAGATGGTA-3'    (SEQ ID NO: 4971)

5'-AAGUGGUAAUUUUUGUACAUUACac-3'    (SEQ ID NO: 4729)
3'-UGUUCACCAUUAAAAACAUGUAAUGUG-5'    (SEQ ID NO: 4486)

KRAS-908 Target:
5'-ACAAGTGGTAATTTTTGTACATTACAC-3'    (SEQ ID NO: 4972)

5'-AGUGGUAAUUUUUGUACAUUACAct-3'    (SEQ ID NO: 4730)
3'-GUUCACCAUUAAAAACAUGUAAUGUGA-5'    (SEQ ID NO: 4487)

KRAS-909 Target:
5'-CAAGTGGTAATTTTTGTACATTACACT-3'    (SEQ ID NO: 4973)

5'-UUGUACAUUACACUAAAUUAUUAgc-3'    (SEQ ID NO: 4731)
3'-AAAACAUGUAAUGUGAUUUAAUAAUCG-5'    (SEQ ID NO: 4488)

KRAS-920 Target:
5'-TTTTGTACATTACACTAAATTATTAGC-3'    (SEQ ID NO: 4974)

5'-UGUACAUUACACUAAAUUAUUAGca-3'    (SEQ ID NO: 4732)
3'-AAACAUGUAAUGUGAUUUAAUAAUCGU-5'    (SEQ ID NO: 4489)

KRAS-921 Target:
5'-TTTGTACATTACACTAAATTATTAGCA-3'    (SEQ ID NO: 4975)

5'-GUACAUUACACUAAAUUAUUAGCat-3'    (SEQ ID NO: 4733)
3'-AACAUGUAAUGUGAUUUAAUAAUCGUA-5'    (SEQ ID NO: 4490)

KRAS-922 Target:
5'-TTGTACATTACACTAAATTATTAGCAT-3'    (SEQ ID NO: 4976)

5'-UACAUUACACUAAAUUAUUAGCAtt-3'    (SEQ ID NO: 4734)
3'-ACAUGUAAUGUGAUUUAAUAAUCGUAA-5'    (SEQ ID NO: 4491)

KRAS-923 Target:
5'-TGTACATTACACTAAATTATTAGCATT-3'    (SEQ ID NO: 4977)

5'-ACAUUACACUAAAUUAUUAGCAUtt-3'    (SEQ ID NO: 4735)
3'-CAUGUAAUGUGAUUUAAUAAUCGUAAA-5'    (SEQ ID NO: 4492)

KRAS-924 Target:
5'-GTACATTACACTAAATTATTAGCATTT-3'    (SEQ ID NO: 4978)

5'-CAUUACACUAAAUUAUUAGCAUUtg-3'    (SEQ ID NO: 4736)
3'-AUGUAAUGUGAUUUAAUAAUCGUAAAC-5'    (SEQ ID NO: 4493)

KRAS-925 Target:
5'-TACATTACACTAAATTATTAGCATTTG-3'    (SEQ ID NO: 4979)

5'-AUUACACUAAAUUAUUAGCAUUUgt-3'    (SEQ ID NO: 4737)
3'-UGUAAUGUGAUU0AAUAAUCGUAAACA-5'    (SEQ ID NO: 4494)
```

TABLE 8-continued

Additional Anti-KRAS Asymmetric (25/27 mer) DsiRNA
Agent Structures Tested in Human HeLa and Mouse
Hepa 1-6 Cells

```
KRAS-926 Target:
5'-ACATTACACTAAATTATTAGCATTTGT-3'        (SEQ ID NO: 4980)

5'-UUACACUAAAUUAUUAGCAUUUGtt-3'       (SEQ ID NO: 4738)
3'-GUAAUGUGAUUUAAUAAUCGUAAACAA-5'        (SEQ ID NO: 4495)

KRAS-927 Target:
5'-CATTACACTAAATTATTAGCATTTGTT-3'        (SEQ ID NO: 4981)

5'-UACACUAAAUUAUUAGCAUUUGUtt-3'       (SEQ ID NO: 4739)
3'-UAAUGUGAUUUAAUAAUCGUAAACAAA-5'        (SEQ ID NO: 4496)

KRAS-928 Target:
5'-ATTACACTAAATTATTAGCATTTGTTT-3'        (SEQ ID NO: 4982)

5'-UAUUAGCAUUUGUUUUAGCAUUAcc-3'       (SEQ ID NO: 4740)
3'-UAAUAAUCGUAAACAAAAUCGUAAUGG-5'        (SEQ ID NO: 4497)

KRAS-938 Target:
5'-ATTATTAGCATTTGTTTTAGCATTACC-3'        (SEQ ID NO: 4983)

5'-AUUAGCAUUUGUUUUAGCAUUACct-3'       (SEQ ID NO: 4741)
3'-AAUAAUCGUAAACAAAAUCGUAAUGGA-5'        (SEQ ID NO: 4498)

KRAS-939 Target:
5'-TTATTAGCATTTGTTTTAGCATTACCT-3'        (SEQ ID NO: 4984)

5'-UUAGCAUUUGUUUUAGCAUUACCta-3'       (SEQ ID NO: 4742)
3'-AUAAUCGUAAACAAAAUCGUAAUGGAU-5'        (SEQ ID NO: 4499)

KRAS-940 Target:
5'-TATTAGCATTTGTTTTAGCATTACCTA-3'        (SEQ ID NO: 4985)

5'-UAGCAUUUGUUUUAGCAUUACCUaa-3'       (SEQ ID NO: 4743)
3'-UAAUCGUAAACAAAAUCGUAAUGGAUU-5'        (SEQ ID NO: 4500)

KRAS-941 Target:
5'-ATTAGCATTTGTTTTAGCATTACCTAA-3'        (SEQ ID NO: 4986)

5'-AGCAUUUGUUUUAGCAUUACCUAat-3'       (SEQ ID NO: 4744)
3'-AAUCGUAAACAAAAUCGUAAUGGAUUA-5'        (SEQ ID NO: 4501)

KRAS-942 Target:
5'-TTAGCATTTGTTTTAGCATTACCTAAT-3'        (SEQ ID NO: 4987)

5'-GCAUUUGUUUUAGCAUUACCUAAtt-3'       (SEQ ID NO: 4745)
3'-AUCGUAAACAAAAUCGUAAUGGAUUAA-5'        (SEQ ID NO: 4502)

KRAS-943 Target:
5'-TAGCATTTGTTTTAGCATTACCTAATT-3'        (SEQ ID NO: 4988)

5'-CAUUUGUUUUAGCAUUACCUAAUtt-3'       (SEQ ID NO: 4746)
3'-UCGUAAACAAAAUCGUAAUGGAUUAAA-5'        (SEQ ID NO: 4503)

KRAS-944 Target:
5'-AGCATTTGTTTTAGCATTACCTAATTT-3'        (SEQ ID NO: 4989)

5'-AUUUGUUUUAGCAUUACCUAAUUtt-3'       (SEQ ID NO: 4747)
3'-CGUAAACAAAAUCGUAAUGGAUUAAAA-5'        (SEQ ID NO: 4504)

KRAS-945 Target:
5'-GCATTTGTTTTAGCATTACCTAATTTT-3'        (SEQ ID NO: 4990)

5'-UUUGUUUUAGCAUUACCUAAUUUtt-3'       (SEQ ID NO: 4748)
3'-GUAAACAAAAUCGUAAUGGAUUAAAAA-5'        (SEQ ID NO: 4505)

KRAS-946 Target:
5'-CATTTGTTTTAGCATTACCTAATTTTT-3'        (SEQ ID NO: 4991)

5'-CUUAUUUUAAAAUGACAGUGGAAgt-3'       (SEQ ID NO: 4749)
3'-ACGAAUAAAAUUUUACUGUCACCUUCA-5'        (SEQ ID NO: 4506)

KRAS-1010 Target:
5'-TGCTTATTTTAAAATGACAGTGGAAGT-3'        (SEQ ID NO: 4992)
```

TABLE 8-continued

Additional Anti-KRAS Asymmetric (25/27 mer) DsiRNA Agent Structures Tested in Human HeLa and Mouse Hepa 1-6 Cells

```
5'-UAUUUUAAAAUGACAGUGGAAGUtt-3'         (SEQ ID NO: 4750)
3'-GAAUAAAAUUUUACUGUCACCUUCAAA-5'       (SEQ ID NO: 4507)

KRAS-1012 Target:
5'-CTTATTTTAAAATGACAGTGGAAGTTT-3'       (SEQ ID NO: 4993)

5'-UCUAAGUGCCAGUAUUCCCAGAGtt-3'       (SEQ ID NO: 4751)
3'-GGAGAUUCACGGUCAUAAGGGUCUCAA-5'       (SEQ ID NO: 4508)

KRAS-1045 Target:
5'-CCTCTAAGTGCCAGTATTCCCAGAGTT-3'       (SEQ ID NO: 4994)

5'-CAAAUUAAUGAAGCUUUUGAAUCat-3'       (SEQ ID NO: 4752)
3'-UUGUUUAAUUACUUCGAAAACUUAGUA-5'       (SEQ ID NO: 4509)

KRAS-1197 Target:
5'-AACAAATTAATGAAGCTTTTGAATCAT-3'       (SEQ ID NO: 4995)

5'-AAAUUAAUGAAGCUUUUGAAUCAtc-3'       (SEQ ID NO: 4753)
3'-UGUUUAAUUACUUCGAAAACUUAGUAG-5'       (SEQ ID NO: 4510)

KRAS-1198 Target:
5'-ACAAATTAATGAAGCTTTTGAATCATC-3'       (SEQ ID NO: 4996)

5'-UGUGUUUUAUCUAGUCACAUAAAtg-3'       (SEQ ID NO: 4754)
3'-AGACACAAAAUAGAUCAGUGUAUUUAC-5'       (SEQ ID NO: 4511)

KRAS-1230 Target:
5'-TCTGTGTTTTATCTAGTCACATAAATG-3'       (SEQ ID NO: 4997)

5'-GUGUUUUAUCUAGUCACAUAAAUgg-3'       (SEQ ID NO: 4755)
3'-GACACAAAAUAGAUCAGUGUAUUUACC-5'       (SEQ ID NO: 4512)

KRAS-1231 Target:
5'-CTGTGTTTTATCTAGTCACATAAATGG-3'       (SEQ ID NO: 4998)

5'-UUUUAUCUAGUCACAUAAAUGGAtt-3'       (SEQ ID NO: 4756)
3'-ACAAAAUAGAUCAGUGUAUUUACCUAA-5'       (SEQ ID NO: 4513)

KRAS-1234 Target:
5'-TGTTTTATCTAGTCACATAAATGGATT-3'       (SEQ ID NO: 4999)

5'-UAAAUGGAUUAAUUACUAAUUUCag-3'       (SEQ ID NO: 4757)
3'-GUAUUUACCUAAUUAAUGAUUAAAGUC-5'       (SEQ ID NO: 4514)

KRAS-1249 Target:
5'-CATAAATGGATTAATTACTAATTTCAG-3'       (SEQ ID NO: 5000)

5'-AAAUGGAUUAAUUACUAAUUUCAgt-3'       (SEQ ID NO: 4758)
3'-UAUUUACCUAAUUAAUGAUUAAAGUCA-5'       (SEQ ID NO: 4515)

KRAS-1250 Target:
5'-ATAAATGGATTAATTACTAATTTCAGT-3'       (SEQ ID NO: 5001)

5'-AUUGGUUUUUACUGAAACAUUGAgg-3'       (SEQ ID NO: 4759)
3'-AUUAACCAAAAAUGACUUUGUAACUCC-5'       (SEQ ID NO: 4516)

KRAS-1287 Target:
5'-TAATTGGTTTTTACTGAAACATTGAGG-3'       (SEQ ID NO: 5002)

5'-CAUUUCCUUUUCACAUUAGAUAAat-3'       (SEQ ID NO: 4760)
3'-CGGUAAAGGAAAAGUGUAAUCUAUUUA-5'       (SEQ ID NO: 4517)

KRAS-1527 Target:
5'-GCCATTTCCTTTTCACATTAGATAAAT-3'       (SEQ ID NO: 5003)

5'-CUUUUCACAUUAGAUAAAUUACUat-3'       (SEQ ID NO: 4761)
3'-AGGAAAAGUGUAAUCUAUUUAAUGAUA-5'       (SEQ ID NO: 4518)

KRAS-1533 Target:
5'-TCCTTTTCACATTAGATAAATTACTAT-3'       (SEQ ID NO: 5004)

5'-CAUUAGAUAAAUUACUAUAAAGAct-3'       (SEQ ID NO: 4762)
3'-GUGUAAUCUAUUUAAUGAUAUUUCUGA-5'       (SEQ ID NO: 4519)
```

TABLE 8-continued

Additional Anti-KRAS Asymmetric (25/27 mer) DsiRNA
Agent Structures Tested in Human HeLa and Mouse
Hepa 1-6 Cells

```
KRAS-1540 Target:
5'-CACATTAGATAAATTACTATAAAGACT-3'        (SEQ ID NO: 5005)

5'-AUUAGAUAAAUUACUAUAAAGACtc-3'       (SEQ ID NO: 4763)
3'-UGUAAUCUAUUUAAUGAUAUUUCUGAG-5'        (SEQ ID NO: 4520)

KRAS-1541 Target:
5'-ACATTAGATAAATTACTATAAAGACTC-3'        (SEQ ID NO: 5006)

5'-UUAGAUAAAUUACUAUAAAGACUcc-3'       (SEQ ID NO: 4764)
3'-GUAAUCUAUUUAAUGAUAUUUCUGAGG-5'        (SEQ ID NO: 4521)

KRAS-1542 Target:
5'-CATTAGATAAATTACTATAAAGACTCC-3'        (SEQ ID NO: 5007)

5'-UAAGGCAGACCCAGUAUGAAAUGggg-3'      (SEQ ID NO: 4765)
3'-CAAUUCCGUCUGGGUCAUACUUUACCC-5'        (SEQ ID NO: 4522)

KRAS-1583 Target:
5'-GTTAAGGCAGACCCAGTATGAAATGGG-3'        (SEQ ID NO: 5008)

5'-AAGGCAGACCCAGUAUGAAAUGGGgg-3'      (SEQ ID NO: 4766)
3'-AAUUCCGUCUGGGUCAUACUUUACCCC-5'        (SEQ ID NO: 4523)

KRAS-1584 Target:
5'-TTAAGGCAGACCCAGTATGAAATGGGG-3'        (SEQ ID NO: 5009)

5'-AGGCAGACCCAGUAUGAAAUGGGGga-3'      (SEQ ID NO: 4767)
3'-AUUCCGUCUGGGUCAUACUUUACCCCU-5'        (SEQ ID NO: 4524)

KRAS-1585 Target:
5'-TAAGGCAGACCCAGTATGAAATGGGGA-3'        (SEQ ID NO: 5010)

5'-GGCAGACCCAGUAUGAAAUGGGGat-3'       (SEQ ID NO: 4768)
3'-UUCCGUCUGGGUCAUACUUUACCCCUA-5'        (SEQ ID NO: 4525)

KRAS-1586 Target:
5'-AAGGCAGACCCAGTATGAAATGGGGAT-3'        (SEQ ID NO: 5011)

5'-UAUGAAAUGGGGAUUAUUAUAGCaa-3'       (SEQ ID NO: 4769)
3'-UCAUACUUUACCCCUAAUAAUAUCGUU-5'        (SEQ ID NO: 4526)

KRAS-1597 Target:
5'-AGTATGAAATGGGGATTATTATAGCAA-3'        (SEQ ID NO: 5012)

5'-GGGAUUAUUAUAGCAACCAUUUUgg-3'       (SEQ ID NO: 4770)
3'-ACCCUAAUAAUAUCGUUGGUAAAACC-5'         (SEQ ID NO: 4527)

KRAS-1606 Target:
5'-TGGGGATTATTATAGCAACCATTTTGG-3'        (SEQ ID NO: 5013)

5'-GGGCUAUAUUUACAUGCUACUAAat-3'       (SEQ ID NO: 4771)
3'-ACCCGAUAUAAAUGUACGAUGAUUUA-5'         (SEQ ID NO: 4528)

KRAS-1630 Target:
5'-TGGGGCTATATTTACATGCTACTAAAT-3'        (SEQ ID NO: 5014)

5'-GGCUAUAUUUACAUGCUACUAAAtt-3'       (SEQ ID NO: 4772)
3'-CCCCGAUAUAAAUGUACGAUGAUUUAA-5'        (SEQ ID NO: 4529)

KRAS-1631 Target:
5'-GGGGCTATATTTACATGCTACTAAATT-3'        (SEQ ID NO: 5015)

5'-GCUAUAUUUACAUGCUACUAAAUtt-3'       (SEQ ID NO: 4773)
3'-CCCGAUAUAAAUGUACGAUGAUUUAAA-5'        (SEQ ID NO: 4530)

KRAS-1632 Target:
5'-GGGCTATATTTACATGCTACTAAATTT-3'        (SEQ ID NO: 5016)

5'-CUAUAUUUACAUGCUACUAAAUUtt-3'       (SEQ ID NO: 4774)
3'-CCGAUAUAAAUGUACGAUGAUUUAAAA-5'        (SEQ ID NO: 4531)

KRAS-1633 Target:
5'-GGCTATATTTACATGCTACTAAATTTT-3'        (SEQ ID NO: 5017)
```

TABLE 8-continued

Additional Anti-KRAS Asymmetric (25/27 mer) DsiRNA
Agent Structures Tested in Human HeLa and Mouse
Hepa 1-6 Cells

```
5'-UAUAUUUACAUGCUACUAAAUUUtt-3'        (SEQ ID NO: 4775)
3'-CGAUAUAAAUGUACGAUGAUUUAAAAA-5'      (SEQ ID NO: 4532)

KRAS-1634 Target:
5'-GCTATATTTACATGCTACTAAATTTTT-3'      (SEQ ID NO: 5018)

5'-AUAUUUACAUGCUACUAAAUUUUta-3'     (SEQ ID NO: 4776)
3'-GAUAUAAAUGUACGAUGAUUUAAAAAU-5'      (SEQ ID NO: 4533)

KRAS-1635 Target:
5'-CTATATTTACATGCTACTAAATTTTTA-3'      (SEQ ID NO: 5019)

5'-UAUUUACAUGCUACUAAAUUUUUat-3'     (SEQ ID NO: 4777)
3'-AUAUAAAUGUACGAUGAUUUAAAAAUA-5'      (SEQ ID NO: 4534)

KRAS-1636 Target:
5'-TATATTTACATGCTACTAAATTTTTAT-3'      (SEQ ID NO: 5020)

5'-AUUUACAUGCUACUAAAUUUUUAta-3'     (SEQ ID NO: 4778)
3'-UAUAAAUGUACGAUGAUUUAAAAAUAU-5'      (SEQ ID NO: 4535)

KRAS-1637 Target:
5'-ATATTTACATGCTACTAAATTTTTATA-3'      (SEQ ID NO: 5021)

5'-UUUACAUGCUACUAAAUUUUUAUaa-3'     (SEQ ID NO: 4779)
3'-AUAAAUGUACGAUGAUUUAAAAAUAUU-5'      (SEQ ID NO: 4536)

KRAS-1638 Target:
5'-TATTTACATGCTACTAAATTTTTATAA-3'      (SEQ ID NO: 5022)

5'-UUACAUGCUACUAAAUUUUUAUAat-3'     (SEQ ID NO: 4780)
3'-UAAAUGUACGAUGAUUUAAAAAUAUUA-5'      (SEQ ID NO: 4537)

KRAS-1639 Target:
5'-ATTTACATGCTACTAAATTTTTATAAT-3'      (SEQ ID NO: 5023)

5'-UACAUGCUACUAAAUUUUUAUAAta-3'     (SEQ ID NO: 4781)
3'-AAAUGUACGAUGAUUUAAAAAUAUUAU-5'      (SEQ ID NO: 4538)

KRAS-1640 Target:
5'-TTTACATGCTACTAAATTTTTATAATA-3'      (SEQ ID NO: 5024)

5'-CUUUCAUAGUAUAACUUUAAAUCtt-3'     (SEQ ID NO: 4782)
3'-GAGAAAGUAUCAUAUUGAAAUUUAGAA-5'      (SEQ ID NO: 4539)

KRAS-1736 Target:
5'-CTCTTTCATAGTATAACTTTAAATCTT-3'      (SEQ ID NO: 5025)

5'-AUAGUAUAACUUUAAAUCUUUUCtt-3'     (SEQ ID NO: 4783)
3'-AGUAUCAUAUUGAAAUUUAGAAAAGAA-5'      (SEQ ID NO: 4540)

KRAS-1741 Target:
5'-TCATAGTATAACTTTAAATCTTTTCTT-3'      (SEQ ID NO: 5026)

5'-UAGUAUAACUUUAAAUCUUUUCUtc-3'     (SEQ ID NO: 4784)
3'-GUAUCAUAUUGAAAUUUAGAAAAGAAG-5'      (SEQ ID NO: 4541)

KRAS-1742 Target:
5'-CATAGTATAACTTTAAATCTTTTCTTC-3'      (SEQ ID NO: 5027)

5'-UAAAUCUUUUCUUCAACUUGAGUct-3'     (SEQ ID NO: 4785)
3'-AAAUUUAGAAAAGAAGUUGAACUCAGA-5'      (SEQ ID NO: 4542)

KRAS-1753 Target:
5'-TTTAAATCTTTTCTTCAACTTGAGTCT-3'      (SEQ ID NO: 5028)

5'-AAAUCUUUUCUUCAACUUGAGUCtt-3'     (SEQ ID NO: 4786)
3'-AAUUUAGAAAAGAAGUUGAACUCAGAA-5'      (SEQ ID NO: 4543)

KRAS-1754 Target:
5'-TTAAATCTTTTCTTCAACTTGAGTCTT-3'      (SEQ ID NO: 5029)

5'-CUUGAGUCUUUGAAGAUAGUUUUaa-3'     (SEQ ID NO: 4787)
3'-UUGAACUCAGAAACUUCUAUCAAAAUU-5'      (SEQ ID NO: 4544)
```

TABLE 8-continued

Additional Anti-KRAS Asymmetric (25/27 mer) DsiRNA Agent Structures Tested in Human HeLa and Mouse Hepa 1-6 Cells

```
KRAS-1769 Target:
5'-AACTTGAGTCTTTGAAGATAGTTTTAA-3'        (SEQ ID NO: 5030)

5'-UGAGUCUUUGAAGAUAGUUUUAAtt-3'      (SEQ ID NO: 4788)
3'-GAACUCAGAAACUUCUAUCAAAAUUAA-5'        (SEQ ID NO: 4545)

KRAS-1771 Target:
5'-CTTGAGTCTTTGAAGATAGTTTTAATT-3'        (SEQ ID NO: 5031)

5'-GAGUCUUUGAAGAUAGUUUUAAUtc-3'      (SEQ ID NO: 4789)
3'-AACUCAGAAACUUCUAUCAAAAUUAAG-5'        (SEQ ID NO: 4546)

KRAS-1772 Target:
5'-TTGAGTCTTTGAAGATAGTTTTAATTC-3'        (SEQ ID NO: 5032)

5'-GAUAGUUUUAAUUCUGCUUGUGAca-3'      (SEQ ID NO: 4790)
3'-UUCUAUCAAAAUUAAGACGAACACUGU-5'        (SEQ ID NO: 4547)

KRAS-1783 Target:
5'-AAGATAGTTTTAATTCTGCTTGTGACA-3'        (SEQ ID NO: 5033)

5'-AUAGUUUUAAUUCUGCUUGUGACat-3'      (SEQ ID NO: 4791)
3'-UCUAUCAAAAUUAAGACGAACACUGUA-5'        (SEQ ID NO: 4548)

KRAS-1784 Target:
5'-AGATAGTTTTAATTCTGCTTGTGACAT-3'        (SEQ ID NO: 5034)

5'-UAGUUUUAAUUCUGCUUGUGACAtt-3'      (SEQ ID NO: 4792)
3'-CUAUCAAAAUUAAGACGAACACUGUAA-5'        (SEQ ID NO: 4549)

KRAS-1785 Target:
5'-GATAGTTTTAATTCTGCTTGTGACATT-3'        (SEQ ID NO: 5035)

5'-CUUGUGACAUUAAAAGAUUAUUUgg-3'      (SEQ ID NO: 4793)
3'-ACGAACACUGUAAUUUUCUAAUAAACC-5'        (SEQ ID NO: 4550)

KRAS-1799 Target:
5'-TGCTTGTGACATTAAAAGATTATTTGG-3'        (SEQ ID NO: 5036)

5'-UAUUAACUCAAAAGUUGAGAUUUtg-3'      (SEQ ID NO: 4794)
3'-UUAUAAUUGAGUUUUCAACUCUAAAAC-5'        (SEQ ID NO: 4551)

KRAS-2100 Target:
5'-AATATTAACTCAAAAGTTGAGATTTTG-3'        (SEQ ID NO: 5037)

5'-UGUGCCAAGACAUUAAUUUUUUUtt-3'      (SEQ ID NO: 4795)
3'-CCACACGGUUCUGUAAUUAAAAAAAAA-5'        (SEQ ID NO: 4552)

KRAS-2134 Target:
5'-GGTGTGCCAAGACATTAATTTTTTTTT-3'        (SEQ ID NO: 5038)

5'-UGGUUAAAUUAACAUUGCAUAAAca-3'      (SEQ ID NO: 4796)
3'-UGACCAAUUUAAUUGUAACGUAUUUGU-5'        (SEQ ID NO: 4553)

KRAS-2216 Target:
5'-ACTGGTTAAATTAACATTGCATAAACA-3'        (SEQ ID NO: 5039)

5'-GGUUAAAUUAACAUUGCAUAAACac-3'      (SEQ ID NO: 4797)
3'-GACCAAUUUAAUUGUAACGUAUUUGUG-5'        (SEQ ID NO: 4554)

KRAS-2217 Target:
5'-CTGGTTAAATTAACATTGCATAAACAC-3'        (SEQ ID NO: 5040)

5'-GUUAAAUUAACAUUGCAUAAACAct-3'      (SEQ ID NO:.4798)
3'-ACCAAUUUAAUUGUAACGUAUUUGUGA-5'        (SEQ ID NO: 4555)

KRAS-2218 Target:
5'-TGGTTAAATTAACATTGCATAAACACT-3'        (SEQ ID NO: 5041)

5'-AUUGCAUAAACACUUUUCAAGUCtg-3'      (SEQ ID NO: 4799)
3'-UGUAACGUAUUUGUGAAAAGUUCAGAC-5'        (SEQ ID NO: 4556)

KRAS-2229 Target:
5'-ACATTGCATAAACACTTTTCAAGTCTG-3'        (SEQ ID NO: 5042)
```

TABLE 8-continued

Additional Anti-KRAS Asymmetric (25/27 mer) DsiRNA
Agent Structures Tested in Human HeLa and Mouse
Hepa 1-6 Cells

```
5'-AAGUCUGAUCCAUAUUUAAUAAUgc-3'       (SEQ ID NO: 4800)
3'-AGUUCAGACUAGGUAUAAAUUAUUACG-5'     (SEQ ID NO: 4557)

KRAS-2247 Target:
5'-TCAAGTCTGATCCATATTTAATAATGC-3'     (SEQ ID NO: 5043)

5'-UAAAAUAAAUGAAGUGAGAUGGCat-3'     (SEQ ID NO: 4801)
3'-AAAUUUUAUUUACUUCACUCUACCGUA-5'     (SEQ ID NO: 4558)

KRAS-2326 Target:
5'-TTTAAAATAAATGAAGTGAGATGGCAT-3'     (SEQ ID NO: 5044)

5'-AAAAUAAAUGAAGUGAGAUGGCAtg-3'     (SEQ ID NO: 4802)
3'-AAUUUUAUUUACUUCACUCUACCGUAC-5'     (SEQ ID NO: 4559)

KRAS-2327 Target:
5'-TTAAAATAAATGAAGTGAGATGGCATG-3'     (SEQ ID NO: 5045)

5'-AAGCUCAGCACAAUCUGUAAAUUtt-3'     (SEQ ID NO: 4803)
3'-AGUUCGAGUCGUGUUAGACAUUUAAAA-5'     (SEQ ID NO: 4560)

KRAS-2547 Target:
5'-TCAAGCTCAGCACAATCTGTAAATTTT-3'     (SEQ ID NO: 5046)

5'-AGCUCAGCACAAUCUGUAAAUUUtt-3'     (SEQ ID NO: 4804)
3'-GUUCGAGUCGUGUUAGACAUUUAAAAA-5'     (SEQ ID NO: 4561)

KRAS-2548 Target:
5'-CAAGCTCAGCACAATCTGTAAATTTTT-3'     (SEQ ID NO: 5047)

5'-AUAACUGUGAUUCUUUUAGGACAat-3'     (SEQ ID NO: 4805)
3'-CGUAUUGACACUAAGAAAAUCCUGUUA-5'     (SEQ ID NO: 4562)

KRAS-3741 Target:
5'-GCATAACTGTGATTCTTTTAGGACAAT-3'     (SEQ ID NO: 5048)

5'-UGUGAUUCUUUUAGGACAAUUACtg-3'     (SEQ ID NO: 4806)
3'-UGACACUAAGAAAAUCCUGUUAAUGAC-5'     (SEQ ID NO: 4563)

KRAS-3746 Target:
5'-ACTGTGATTCTTTTAGGACAATTACTG-3'     (SEQ ID NO: 5049)

5'-GUGAUUCUUUUAGGACAAUUACUgt-3'     (SEQ ID NO: 4807)
3'-GACACUAAGAAAAUCCUGUUAAUGACA-5'     (SEQ ID NO: 4564)

KRAS-3747 Target:
5'-CTGTGATTCTTTTAGGACAATTACTGT-3'     (SEQ ID NO: 5050)

5'-UGUAUGUCAGAUAUUCAUAUUGAcc-3'     (SEQ ID NO: 4808)
3'-CCACAUACAGUCUAUAAGUAUAACUGG-5'     (SEQ ID NO: 4565)

KRAS-3783 Target:
5'-GGTGTATGTCAGATATTCATATTGACC-3'     (SEQ ID NO: 5051)

5'-GUAUGUCAGAUAUUCAUAUUGACcc-3'     (SEQ ID NO: 4809)
3'-CACAUACAGUCUAUAAGUAUAACUGGG-5'     (SEQ ID NO: 4566)

KRAS-3784 Target:
5'-GTGTATGTCAGATATTCATATTGACCC-3'     (SEQ ID NO: 5052)

5'-AAUGUGUAAUAUUCCAGUUUUCUct-3'     (SEQ ID NO: 4810)
3'-GUUUACACAUUAUAAGGUCAAAAGAGA-5'     (SEQ ID NO: 4567)

KRAS-3810 Target:
5'-CAAATGTGTAATATTCCAGTTTTCTCT-3'     (SEQ ID NO: 5053)

5'-CACUGCAUAGGAAUUUAGAACCUaa-3'     (SEQ ID NO: 4811)
3'-GUGUGACGUAUCCUUAAAUCUUGGAUU-5'     (SEQ ID NO: 4568)

KRAS-4396 Target:
5'-CACACTGCATAGGAATTTAGAACCTAA-3'     (SEQ ID NO: 5054)

5'-CACCAUUGCACAAUUUUGUCCUAat-3'     (SEQ ID NO: 4812)
3'-CAGUGGUAACGUGUUAAAACAGGAUUA-5'     (SEQ ID NO: 4569)
```

TABLE 8-continued

Additional Anti-KRAS Asymmetric (25/27 mer) DsiRNA
Agent Structures Tested in Human HeLa and Mouse
Hepa 1-6 Cells

```
KRAS-4447 Target:
5'-GTCACCATTGCACAATTTTGTCCTAAT-3'        (SEQ ID NO: 5055)

5'-ACCAUUGCACAAUUUUGUCCUAAta-3'       (SEQ ID NO: 4813)
3'-AGUGGUAACGUGUUAAAACAGGAUUAU-5'        (SEQ ID NO: 4570)

KRAS-4448 Target:
5'-TCACCATTGCACAATTTTGTCCTAATA-3'        (SEQ ID NO: 5056)

5'-CCAUUGCACAAUUUUGUCCUAAUat-3'       (SEQ ID NO: 4814)
3'-GUGGUAACGUGUUAAAACAGGAUUAUA-5'        (SEQ ID NO: 4571)

KRAS-4449 Target:
5'-CACCATTGCACAATTTTGTCCTAATAT-3'        (SEQ ID NO: 5057)

5'-CAUUGCACAAUUUUGUCCUAAUAta-3'       (SEQ ID NO: 4815)
3'-UGGUAACGUGUUAAAACAGGAUUAUAU-5'        (SEQ ID NO: 4572)

KRAS-4450 Target:
5'-ACCATTGCACAATTTTGTCCTAATATA-3'        (SEQ ID NO: 5058)

5'-AUUGCACAAUUUUGUCCUAAUAUat-3'       (SEQ ID NO: 4816)
3'-GGUAACGUGUUAAAACAGGAUUAUAUA-5'        (SEQ ID NO: 4573)

KRAS-4451 Target:
5'-CCATTGCACAATTTTGTCCTAATATAT-3'        (SEQ ID NO: 5059)

5'-UUGCACAAUUUUGUCCUAAUAUAta-3'       (SEQ ID NO: 4817)
3'-GUAACGUGUUAAAACAGGAUUAUAUAU-5'        (SEQ ID NO: 4574)

KRAS-4452 Target:
5'-CATTGCACAATTTTGTCCTAATATATA-3'        (SEQ ID NO: 5060)

5'-UAGCAUGAAUUCUGCAUUGAGAAAac-3'      (SEQ ID NO: 4818)
3'-CUAUCGUACUUAAGACGUAACUCUUUG-5'        (SEQ ID NO: 4575)

KRAS-4748 Target:
5'-GATAGCATGAATTCTGCATTGAGAAAC-3'        (SEQ ID NO: 5061)

5'-AGCAUGAAUUCUGCAUUGAGAAAct-3'       (SEQ ID NO: 4819)
3'-UAUCGUACUUAAGACGUAACUCUUUGA-5'        (SEQ ID NO: 4576)

KRAS-4749 Target:
5'-ATAGCATGAATTCTGCATTGAGAAACT-3'        (SEQ ID NO: 5062)

5'-UUUGAAGUGCCUGUUUGGGAUAAtg-3'       (SEQ ID NO: 4820)
3'-UCAAACUUCACGGACAAACCCUAUUAC-5'        (SEQ ID NO: 4577)

KRAS-4878 Target:
5'-AGTTTGAAGTGCCTGTTTGGGATAATG-3'        (SEQ ID NO: 5063)

5'-UUGAAGUGCCUGUUUGGGAUAAUga-3'       (SEQ ID NO: 4821)
3'-CAAACUUCACGGACAAACCCUAUUACU-5'        (SEQ ID NO: 4578)

KRAS-4879 Target:
5'-GTTTGAAGTGCCTGTTTGGGATAATGA-3'        (SEQ ID NO: 5064)

5'-UGAAGUGCCUGUUUGGGAUAAUGat-3'       (SEQ ID NO: 4822)
3'-AAACUUCACGGACAAACCCUAUUACUA-5'        (SEQ ID NO: 4579)

KRAS-4880 Target:
5'-TTTGAAGTGCCTGTTTGGGATAATGAT-3'        (SEQ ID NO: 5065)

5'-UUUGAGUGCCAAUUUCUUACUAGta-3'       (SEQ ID NO: 4823)
3'-GGAAACUCACGGUUAAAGAAUGAUCAU-5'        (SEQ ID NO: 4580)

KRAS-5073 Target:
5'-CCTTTGAGTGCCAATTTCTTACTAGTA-3'        (SEQ ID NO: 5066)

5'-UUGAGUGCCAAUUUCUUACUAGUac-3'       (SEQ ID NO: 4824)
3'-GAAACUCACGGUUAAAGAAUGAUCAUG-5'        (SEQ ID NO: 4581)

KRAS-5074 Target:
5'-CTTTGAGTGCCAATTTCTTACTAGTAC-3'        (SEQ ID NO: 5067)
```

TABLE 8-continued

Additional Anti-KRAS Asymmetric (25/27 mer) DsiRNA
Agent Structures Tested in Human HeLa and Mouse
Hepa 1-6 Cells

```
5'-UGAGUGCCAAUUUCUUACUAGUAct-3'    (SEQ ID NO: 4825)
3'-AAACUCACGGUUAAAGAAUGAUCAUGA-5'  (SEQ ID NO: 4582)

KRAS-5075 Target:
5'-TTTGAGTGCCAATTTCTTACTAGTACT-3'  (SEQ ID NO: 5068)

5'-GAGUGCCAAUUUCUUACUAGUACta-3'  (SEQ ID NO: 4826)
3'-AACUCACGGUUAAAGAAUGAUCAUGAU-5'  (SEQ ID NO: 4583)

KRAS-5076 Target:
5'-TTGAGTGCCAATTTCTTACTAGTACTA-3'  (SEQ ID NO: 5069)

5'-AGUGCCAAUUUCUUACUAGUACUat-3' (SEQ ID NO: 4827)
3'-ACUCACGGUUAAAGAAUGAUCAUGAUA-5'  (SEQ ID NO: 4584)

KRAS-5077 Target:
5'-TGAGTGCCAATTTCTTACTAGTACTAT-3'  (SEQ ID NO: 5070)

5'-GUGCCAAUUUCUUACUAGUACUAtt-3' (SEQ ID NO: 4828)
3'-CUCACGGUUAAAGAAUGAUCAUGAUAA-5'  (SEQ ID NO: 4585)

KRAS-5078 Target:
5'-GAGTGCCAATTTCTTACTAGTACTATT-3'  (SEQ ID NO: 5071)

5'-AUGUAUUUUAACUAUUUUUGUAUag-3' (SEQ ID NO: 4829)
3'-CUUACAUAAAAUUGAUAAAAACAUAUC-5'  (SEQ ID NO: 4586)

KRAS-5128 Target:
5'-GAATGTATTTTAACTATTTTGTATAG-3'   (SEQ ID NO: 5072)

5'-UGUAUUUUAACUAUUUUUGUAUAgt-3' (SEQ ID NO: 4830)
3'-UUACAUAAAAUUGAUAAAAACAUAUCA-5'  (SEQ ID NO: 4587)

KRAS-5129 Target:
5'-AATGTATTTTAACTATTTTGTATAGT-3'   (SEQ ID NO: 5073)

5'-ACUAUUUUGUAUAGUGUAAACUga-3'  (SEQ ID NO: 4831)
3'-AUUGAUAAAAACAUAUCACAUUUGACU-5'  (SEQ ID NO: 4588)

KRAS-5138 Target:
5'-TAACTATTTTGTATAGTGTAAACTGA-3'   (SEQ ID NO: 5074)

5'-CUAUUUUGUAUAGUGUAAACUGaa-3'  (SEQ ID NO: 4832)
3'-UUGAUAAAAACAUAUCACAUUUGACUU-5'  (SEQ ID NO: 4589)

KRAS-5139 Target:
5'-AACTATTTTGTATAGTGTAAACTGAA-3'   (SEQ ID NO: 5075)

5'-UAUUUUGUAUAGUGUAAACUGAaa-3'  (SEQ ID NO: 4833)
3'-UGAUAAAAACAUAUCACAUUUGACUUU-5'  (SEQ ID NO: 4590)

KRAS-5140 Target:
5'-ACTATTTTGTATAGTGTAAACTGAAA-3'   (SEQ ID NO: 5076)

5'-AUUUUGUAUAGUGUAAACUGAAac-3'  (SEQ ID NO: 4834)
3'-GAUAAAAACAUAUCACAUUUGACUUUG-5'  (SEQ ID NO: 4591)

KRAS-5141 Target:
5'-CTATTTTGTATAGTGTAAACTGAAAC-3'   (SEQ ID NO: 5077)

5'-UUUUUGUAUAGUGUAAACUGAAAca-3' (SEQ ID NO: 4835)
3'-AUAAAAACAUAUCACAUUUGACUUUGU-5'  (SEQ ID NO: 4592)

KRAS-5142 Target:
5'-TATTTTGTATAGTGTAAACTGAAACA-3'   (SEQ ID NO: 5078)

5'-UUUUGUAUAGUGUAAACUGAAACat-3' (SEQ ID NO: 4836)
3'-UAAAAACAUAUCACAUUUGACUUUGUA-5'  (SEQ ID NO: 4593)

KRAS-5143 Target:
5'-ATTTTGTATAGTGTAAACTGAAACAT-3'   (SEQ ID NO: 5079)

5'-AACAUGCACAUUUGUACAUUGUgc-3'  (SEQ ID NO: 4837)
3'-CUUUGUACGUGUAAAACAUGUAACACG-5'  (SEQ ID NO: 4594)
```

TABLE 8-continued

Additional Anti-KRAS Asymmetric (25/27 mer) DsiRNA Agent Structures Tested in Human HeLa and Mouse Hepa 1-6 Cells

```
KRAS-5163 Target:
5'-GAAACATGCACATTTTGTACATTGTGC-3'          (SEQ ID NO: 5080)

5'-ACAUGCACAUUUUGUACAUUGUGct-3'        (SEQ ID NO: 4838)
3'-UUUGUACGUGUAAAACAUGUAACACGA-5'          (SEQ ID NO: 4595)

KRAS-5164 Target:
5'-AAACATGCACATTTTGTACATTGTGCT-3'          (SEQ ID NO: 5081)

5'-UGCACAUUUUGUACAUUGUGCUUtc-3'        (SEQ ID NO: 4839)
3'-GUACGUGUAAAACAUGUAACACGAAAG-5'          (SEQ ID NO: 4596)

KRAS-5167 Target:
5'-CATGCACATTTTGTACATTGTGCTTTC-3'          (SEQ ID NO: 5082)

5'-GCACAUUUUGUACAUUGUGCUUUct-3'        (SEQ ID NO: 4840)
3'-UACGUGUAAAACAUGUAACACGAAAGA-5'          (SEQ ID NO: 4597)

KRAS-5168 Target:
5'-ATGCACATTTTGTACATTGTGCTTTCT-3'          (SEQ ID NO: 5083)

5'-CACAUUUUGUACAUUGUGCUUUCtt-3'        (SEQ ID NO: 4841)
3'-ACGUGUAAAACAUGUAACACGAAAGAA-5'          (SEQ ID NO: 4598)

KRAS-5169 Target:
5'-TGCACATTTTGTACATTGTGCTTTCTT-3'          (SEQ ID NO: 5084)

5'-ACAUUUUGUACAUUGUGCUUUCUtt-3'        (SEQ ID NO: 4842)
3'-CGUGUAAAACAUGUAACACGAAAGAAA-5'          (SEQ ID NO: 4599)

KRAS-5170 Target:
5'-GCACATTTTGTACATTGTGCTTTCTTT-3'          (SEQ ID NO: 5085)

5'-CAUUUUGUACAUUGUGCUUUCUUtt-3'        (SEQ ID NO: 4843)
3'-GUGUAAAACAUGUAACACGAAAGAAAA-5'          (SEQ ID NO: 4600)

KRAS-5171 Target:
5'-CACATTTTGTACATTGTGCTTTCTTTT-3'          (SEQ ID NO: 5086)

5'-AUUUUGUACAUUGUGCUUUCUUUtg-3'        (SEQ ID NO: 4844)
3'-UGUAAAACAUGUAACACGAAAGAAAAC-5'          (SEQ ID NO: 4601)

KRAS-5172 Target:
5'-ACATTTTGTACATTGTGCTTTCTTTTG-3'          (SEQ ID NO: 5087)

5'-UUUUGUACAUUGUGCUUUCUUUUgt-3'        (SEQ ID NO: 4845)
3'-GUAAAACAUGUAACACGAAAGAAAACA-5'          (SEQ ID NO: 4602)

KRAS-5173 Target:
5'-CATTTTGTACATTGTGCTTTCTTTTGT-3'          (SEQ ID NO: 5088)

5'-UGGGACAUAUGCAGUGUGAUCCAgt-3'        (SEQ ID NO: 4846)
3'-ACACCCUGUAUACGUCACACUAGGUCA-5'          (SEQ ID NO: 4603)

KRAS-5197 Target:
5'-TGTGGGACATATGCAGTGTGATCCAGT-3'          (SEQ ID NO: 5089)

5'-GGGACAUAUGCAGUGUGAUCCAGtt-3'        (SEQ ID NO: 4847)
3'-CACCCUGUAUACGUCACACUAGGUCAA-5'          (SEQ ID NO: 4604)

KRAS-5198 Target:
5'-GTGGGACATATGCAGTGTGATCCAGTT-3'          (SEQ ID NO: 5090)

5'-GGACAUAUGCAGUGUGAUCCAGUtg-3'        (SEQ ID NO: 4848)
3'-ACCCUGUAUACGUCACACUAGGUCAAC-5'          (SEQ ID NO: 4605)

KRAS-5199 Target:
5'-TGGGACATATGCAGTGTGATCCAGTTG-3'          (SEQ ID NO: 5091)

5'-GACAUAUGCAGUGUGAUCCAGUUgt-3'        (SEQ ID NO: 4849)
3'-CCCUGUAUACGUCACACUAGGUCAACA-5'          (SEQ ID NO: 4606)

KRAS-5200 Target:
5'-GGGACATATGCAGTGTGATCCAGTTGT-3'          (SEQ ID NO: 5092)
```

TABLE 8-continued

Additional Anti-KRAS Asymmetric (25/27 mer) DsiRNA Agent Structures Tested in Human HeLa and Mouse Hepa 1-6 Cells

```
5'-ACAUAUGCAGUGUGAUCCAGUUGtt-3'       (SEQ ID NO: 4850)
3'-CCUGUAUACGUCACACUAGGUCAACAA-5'     (SEQ ID NO: 4607)

KRAS-5201 Target:
5'-GGACATATGCAGTGTGATCCAGTTGTT-3'     (SEQ ID NO: 5093)

5'-CAUAUGCAGUGUGAUCCAGUUGUtt-3'     (SEQ ID NO: 4851)
3'-CUGUAUACGUCACACUAGGUCAACAAA-5'     (SEQ ID NO: 4608)

KRAS-5202 Target:
5'-GACATATGCAGTGTGATCCAGTTGTTT-3'     (SEQ ID NO: 5094)

5'-AUAUGCAGUGUGAUCCAGUUGUUtt-3'     (SEQ ID NO: 4852)
3'-UGUAUACGUCACACUAGGUCAACAAAA-5'     (SEQ ID NO: 4609)

KRAS-5203 Target:
5'-ACATATGCAGTGTGATCCAGTTGTTTT-3'     (SEQ ID NO: 5095)

5'-UAUGCAGUGUGAUCCAGUUGUUUtc-3'     (SEQ ID NO: 4853)
3'-GUAUACGUCACACUAGGUCAACAAAAG-5'     (SEQ ID NO: 4610)

KRAS-5204 Target:
5'-CATATGCAGTGTGATCCAGTTGTTTTC-3'     (SEQ ID NO: 5096)

5'-AUGCAGUGUGAUCCAGUUGUUUUcc-3'     (SEQ ID NO: 4854)
3'-UAUACGUCACACUAGGUCAACAAAAGG-5'     (SEQ ID NO: 4611)

KRAS-5205 Target:
5'-ATATGCAGTGTGATCCAGTTGTTTTCC-3'     (SEQ ID NO: 5097)

5'-AGUGUGAUCCAGUUGUUUUCCAUca-3'     (SEQ ID NO: 4855)
3'-CGUCACACUAGGUCAACAAAAGGUAGU-5'     (SEQ ID NO: 4612)

KRAS-5209 Target:
5'-GCAGTGTGATCCAGTTGTTTTCCATCA-3'     (SEQ ID NO: 5098)

5'-GUGUGAUCCAGUUGUUUUCCAUCat-3'     (SEQ ID NO: 4856)
3'-GUCACACUAGGUCAACAAAAGGUAGUA-5'     (SEQ ID NO: 4613)

KRAS-5210 Target:
5'-CAGTGTGATCCAGTTGTTTTCCATCAT-3'     (SEQ ID NO: 5099)

5'-UGUGAUCCAGUUGUUUUCCAUCAtt-3'     (SEQ ID NO: 4857)
3'-UCACACUAGGUCAACAAAAGGUAGUAA-5'     (SEQ ID NO: 4614)

KRAS-5211 Target:
5'-AGTGTGATCCAGTTGTTTTCCATCATT-3'     (SEQ ID NO: 5100)

5'-GUGAUCCAGUUGUUUUCCAUCAUtt-3'     (SEQ ID NO: 4858)
3'-CACACUAGGUCAACAAAAGGUAGUAAA-5'     (SEQ ID NO: 4615)

KRAS-5212 Target:
5'-GTGTGATCCAGTTGTTTTCCATCATTT-3'     (SEQ ID NO: 5101)

5'-UGAUCCAGUUGUUUUCCAUCAUUtg-3'     (SEQ ID NO: 4859)
3'-ACACUAGGUCAACAAAAGGUAGUAAAC-5'     (SEQ ID NO: 4616)

KRAS-5213 Target:
5'-TGTGATCCAGTTGTTTTCCATCATTTG-3'     (SEQ ID NO: 5102)

5'-GAUCCAGUUGUUUUCCAUCAUUUgg-3'     (SEQ ID NO: 4860)
3'-CACUAGGUCAACAAAAGGUAGUAAACC-5'     (SEQ ID NO: 4617)

KRAS-5214 Target:
5'-GTGATCCAGTTGTTTTCCATCATTTGG-3'     (SEQ ID NO: 5103)

5'-UUUGGUUGCGCUGACCUAGGAAUgt-3'     (SEQ ID NO: 4861)
3'-GUAAACCAACGCGACUGGAUCCUUACA-5'     (SEQ ID NO: 4618)

KRAS-5234 Target:
5'-CATTTGGTTGCGCTGACCTAGGAATGT-3'     (SEQ ID NO: 5104)

5'-UUGGUUGCGCUGACCUAGGAAUGtt-3'     (SEQ ID NO: 4862)
3'-UAAACCAACGCGACUGGAUCCUUACAA-5'     (SEQ ID NO: 4619)
```

TABLE 8-continued

Additional Anti-KRAS Asymmetric (25/27 mer) DsiRNA Agent Structures Tested in Human HeLa and Mouse Hepa 1-6 Cells

```
KRAS-5235 Target:
5'-ATTTGGTTGCGCTGACCTAGGAATGTT-3'       (SEQ ID NO: 5105)

5'-GGAAUGUUGGUCAUAUCAAACAUta-3'     (SEQ ID NO: 4863)
3'-AUCCUUACAACCAGUAUAGUUUGUAAU-5'       (SEQ ID NO: 4620)

KRAS-5252 Target:
5'-TAGGAATGTTGGTCATATCAAACATTA-3'       (SEQ ID NO: 5106)

5'-GAAUGUUGGUCAUAUCAAACAUUaa-3'     (SEQ ID NO: 4864)
3'-UCCUUACAACCAGUAUAGUUUGUAAUU-5'       (SEQ ID NO: 4621)

KRAS-5253 Target:
5'-AGGAATGTTGGTCATATCAAACATTAA-3'       (SEQ ID NO: 5107)

5'-AAUGUUGGUCAUAUCAAACAUUAaa-3'     (SEQ ID NO: 4865)
3'-CCUUACAACCAGUAUAGUUUGUAAUUU-5'       (SEQ ID NO: 4622)

KRAS-5254 Target:
5'-GGAATGTTGGTCATATCAAACATTAAA-3'       (SEQ ID NO: 5108)

5'-AUGUUGGUCAUAUCAAACAUUAAaa-3'     (SEQ ID NO: 4866)
3'-CUUACAACCAGUAUAGUUUGUAAUUUU-5'       (SEQ ID NO: 4623)

KRAS-5255 Target:
5'-GAATGTTGGTCATATCAAACATTAAAA-3'       (SEQ ID NO: 5109)

5'-UGUUGGUCAUAUCAAACAUUAAAaa-3'     (SEQ ID NO: 4867)
3'-UUACAACCAGUAUAGUUUGUAAUUUUU-5'       (SEQ ID NO: 4624)

KRAS-5256 Target:
5'-AATGTTGGTCATATCAAACATTAAAAA-3'       (SEQ ID NO: 5110)

5'-GUUGGUCAUAUCAAACAUUAAAAat-3'     (SEQ ID NO: 4868)
3'-UACAACCAGUAUAGUUUGUAAUUUUUA-5'       (SEQ ID NO: 4625)

KRAS-5257 Target:
5'-ATGTTGGTCATATCAAACATTAAAAAT-3'       (SEQ ID NO: 5111)

5'-UUGGUCAUAUCAAACAUUAAAAAtg-3'     (SEQ ID NO: 4869)
3'-ACAACCAGUAUAGUUUGUAAUUUUUAC-5'       (SEQ ID NO: 4626)

KRAS-5258 Target:
5'-TGTTGGTCATATCAAACATTAAAAATG-3'       (SEQ ID NO: 5112)

5'-UGGUCAUAUCAAACAUUAAAAAUga-3'     (SEQ ID NO: 4870)
3'-CAACCAGUAUAGUUUGUAAUUUUUACU-5'       (SEQ ID NO: 4627)

KRAS-5259 Target:
5'-GTTGGTCATATCAAACATTAAAAATGA-3'       (SEQ ID NO: 5113)

5'GGUCAUAUCAAACAUUAAAAAUGac.73'     (SEQ ID NO: 4871)
3'-AACCAGUAUAGUUUGUAAUUUUUACUG-5'       (SEQ ID NO: 4628)

KRAS-5260 Target:
5'-TTGGTCATATCAAACATTAAAAATGAC-3'       (SEQ ID NO: 5114)

5'-AAAUUAACUUUUAAAUGUUUAUAgg-3'     (SEQ ID NO: 4872)
3'-ACUUUAAUUGAAAAUUUACAAAUAUCC-5'       (SEQ ID NO: 4629)

KRAS-5299 Target:
5'-TGAAATTAACTTTTAAATGTTTATAGG-3'       (SEQ ID NO: 5115)

5'-AAUUAACUUUUAAAUGUUUAUAGga-3'     (SEQ ID NO: 4873)
3'-CUUUAAUUGAAAAUUUACAAAUAUCCU-5'       (SEQ ID NO: 4630)

KRAS-5300 Target:
5'-GAAATTAACTTTTAAATGTTTATAGGA-3'       (SEQ ID NO: 5116)

5'-AACUUUUAAAUGUUUAUAGGAGUat-3'     (SEQ ID NO: 4874)
3'-AAUUGAAAAUUUACAAAUAUCCUCAUA-5'       (SEQ ID NO: 4631)

KRAS-5304 Target:
5'-TTAACTTTTAAATGTTTATAGGAGTAT-3'       (SEQ ID NO: 5117)
```

TABLE 8-continued

Additional Anti-KRAS Asymmetric (25/27 mer) DsiRNA Agent Structures Tested in Human HeLa and Mouse Hepa 1-6 Cells

```
5'-ACUUUAAAUGUUUAUAGGAGUAtg-3'        (SEQ ID NO: 4875)
3'-AUUGAAAAUUUACAAAUAUCCUCAUAC-5'     (SEQ ID NO: 4632)

KRAS-5305 Target:
5'-TAACTTTTAAATGTTTATAGGAGTATG-3'     (SEQ ID NO: 5118)

5'-CUUUUAAAUGUUUAUAGGAGUAUgt-3'    (SEQ ID NO: 4876)
   3'-UUGAAAAUUUACAAAUAUCCUCAUACA-5'  (SEQ ID NO: 4633)

KRAS-5306 Target:
5'-AACTTTTAAATGTTTATAGGAGTATGT-3'     (SEQ ID NO: 5119)

5'-UUUUAAAUGUUUAUAGGAGUAUGtg-3'    (SEQ ID NO: 4877)
   3'-UGAAAAUUUACAAAUAUCCUCAUACAC-5'  (SEQ ID NO: 4634)

KRAS-5307 Target:
5'-ACTTTTAAATGTTTATAGGAGTATGTG-3'     (SEQ ID NO: 5120)

5'-UUUAAAUGUUUAUAGGAGUAUGUgc-3'    (SEQ ID NO: 4878)
   3'-GAAAAUUUACAAAUAUCCUCAUACACG-5'  (SEQ ID NO: 4635)

KRAS-5308 Target:
5'-CTTTTAAATGTTTATAGGAGTATGTGC-3'     (SEQ ID NO: 5121)

5'-UUAAAUGUUUAUAGGAGUAUGUGct-3'    (SEQ ID NO: 4879)
   3'-AAAAUUUACAAAUAUCCUCAUACACGA-5'  (SEQ ID NO: 4636)

KRAS-5309 Target:
5'-TTTTAAATGTTTATAGGAGTATGTGCT-3'     (SEQ ID NO: 5122)

5'-AAAUUUGUAAUAUUUUUGUCAUGaa-3'    (SEQ ID NO: 4880)
   3'-AUUUUAAACAUUAUAAAAACAGUACUU-5'  (SEQ ID NO: 4637)

KRAS-5347 Target:
5'-TAAAATTTGTAATATTTTTGTCATGAA-3'     (SEQ ID NO: 5123)

5'-AAUUUGUAAUAUUUUUGUCAUGAac-3'    (SEQ ID NO: 4881)
   3'-UUUUAAACAUUAUAAAAACAGUACUUG-5'  (SEQ ID NO: 4638)

KRAS-5348 Target:
5'-AAAATTTGTAATATTTTTGTCATGAAC-3'     (SEQ ID NO: 5124)

5'-AUUUGUAAUAUUUUUGUCAUGAAct-3'    (SEQ ID NO: 4882)
   3'-UUUAAACAUUAUAAAAACAGUACUUGA-5'  (SEQ ID NO: 4639)

KRAS-5349 Target:
5'-AAATTTGTAATATTTTTGTCATGAACT-3'     (SEQ ID NO: 5125)

5'-UUUGUAAUAU6UUUGUCAUGAACtg-3'    (SEQ ID NO: 4883)
   3'-UUAAACAUUAUAAAAACAGUACUUGAC-5'  (SEQ ID NO: 4640)

KRAS-5350 Target:
5'-AATTTGTAATATTTTTGTCATGAACTG-3'     (SEQ ID NO: 5126)

5'-UUGUAAUAUUUUUGUCAUGAACUgt-3'    (SEQ ID NO: 4884)
   3'-UAAACAUUAUAAAAACAGUACUUGACA-5'  (SEQ ID NO: 4641)

KRAS-5351 Target:
5'-ATTTGTAATATTTTTGTCATGAACTGT-3'     (SEQ ID NO: 5127)

5'-UGUAAUAUUUUUGUCAUGAACUGta-3'    (SEQ ID NO: 4885)
   3'-AAACAUUAUAAAAACAGUACUUGACAU-5'  (SEQ ID NO: 4642)

KRAS-5352 Target:
5'-TTTGTAATATTTTTGTCATGAACTGTA-3'     (SEQ ID NO: 5128)

5'-GUAAUAUUUUUGUCAUGAACUGUac-3'    (SEQ ID NO: 4886)
   3'-AACAUUAUAAAAACAGUACUUGACAUG-5'  (SEQ ID NO: 4643)

KRAS-5353 Target:
5'-TTGTAATATTTTTGTCATGAACTGTAC-3'     (SEQ ID NO: 5129)

5'-UAAUAUUUUUGUCAUGAACUGUAct-3'    (SEQ ID NO: 4887)
   3'-ACAUUAUAAAAACAGUACUUGACAUGA-5'  (SEQ ID NO: 4644)
```

TABLE 8-continued

Additional Anti-KRAS Asymmetric (25/27 mer) DsiRNA
Agent Structures Tested in Human HeLa and Mouse
Hepa 1-6 Cells

```
KRAS-5354 Target:
5'-TGTAATATTTTTGTCATGAACTGTACT-3'         (SEQ ID NO: 5130)

5'-AUUGUAAUGUAAUAAAAAUAGUUac-3'         (SEQ ID NO: 4888)
3'-AAUAACAUUACAUUAUUUUUAUCAAUG-5'         (SEQ ID NO: 4645)

KRAS-5389 Target:
5'-TTATTGTAATGTAATAAAAATAGTTAC-3'         (SEQ ID NO: 5131)

5'-UUGUAAUGUAAUAAAAAUAGUUAca-3'         (SEQ ID NO: 4889)
3'-AUAACAUUACAUUAUUUUUAUCAAUGU-5'         (SEQ ID NO: 4646)

KRAS-5390 Target:
5'-TATTGTAATGTAATAAAAATAGTTACA-3'         (SEQ ID NO: 5132)

5'-UGUAAUGUAAUAAAAAUAGUUACag-3'         (SEQ ID NO: 4890)
3'-UAACAUUACAUUAUUUUUAUCAAUGUC-5'         (SEQ ID NO: 4647)

KRAS-5391 Target:
5'-ATTGTAATGTAATAAAAATAGTTACAG-3'         (SEQ ID NO: 5133)

5'-GUAAUGUAAUAAAAAUAGUUACAgt-3'         (SEQ ID NO: 4891)
3'-AACAUUACAUUAUUUUUAUCAAUGUCA-5'         (SEQ ID NO: 4648)

KRAS-5392 Target:
5'-TTGTAATGTAATAAAAATAGTTACAGT-3'         (SEQ ID NO: 5134)

5'-UAAUGUAAUAAAAAUAGUUACAGtg-3'         (SEQ ID NO: 4892)
3'-ACAUUACAUUAUUUUUAUCAAUGUCAC-5'         (SEQ ID NO: 4649)

KRAS-5393 Target:
5'-TGTAATGTAATAAAAATAGTTACAGTG-3'         (SEQ ID NO: 5135)
```

As in Tables 2-5 above, underlined nucleotide residues of above Table 8 indicate 2'-O-methyl modified residues; ribonucleotide residues are shown as UPPER CASE, while deoxyribonucleotide residues are shown as lower case.

Assay of the above 243 KRAS targeting DsiRNAs in human HeLa and mouse Hepa 1-6 cells at 1 nM revealed the following KRAS inhibitory efficacies, presented in Table 9.

KRAS levels were determined using paired qPCR assays positioned at distinct locations within the KRAS transcript (for HeLa cell experiments, qPCR assays are indicated as "Hs KRAS 268-385 (MAX)" and "Hs KRAS 3393-3516 (FAM)"; for Hepa 1-6 cell experiments, such assays are indicated as "Mm KRAS 279-390 (MAX)" and "Mm KRAS1064-1161 (FAM)").

TABLE 9

KRAS Inhibitory Efficacy of Table 8 DsiRNAs Assayed at 1 nM in Human HeLa and Mouse Hepa 1-6 Cells

| | | | | Human - HeLa Normalized HPRT/SFRS9; vs NC1, NC5, NC7 | | | | Mouse - Hepa 1-6 Normalized HPRT/Rpl23; vs NC1, NC5, NC7 | | | |
|---|---|---|---|---|---|---|---|---|---|---|---|
| | | | | Assay: Hs KRAS 268-385 (MAX) | | Assay: Hs KRAS 3393-3516 (FAM) | | Assay: Mm KRAS 279-390 (MAX) | | Assay: Mm KRAS 1064-1161 (FAM) | |
| Name | Hs Loc | Mm Loc | nM | % Left Ave | % Error | % Left Ave | % Error | % Left Ave | % Error | % Left Ave | % Error |
| Hs|NM_033360.2|166 | 166 | 179 | 1 | 16.9 | 5.8 | 18.8 | 8.6 | 43.4 | 1.0 | 47.5 | 5.1 |
| Hs|NM_033360.2|167 | 167 | 180 | 1 | 22.4 | 6.8 | 28.5 | 5.4 | 54.1 | 5.0 | 53.0 | 2.7 |
| Hs|NM_033360.2|168 | 168 | 181 | 1 | 12.0 | 3.0 | 20.1 | 4.2 | 47.9 | 3.9 | 43.7 | 2.6 |
| Hs|NM_033360.2|169 | 169 | 182 | 1 | 12.4 | 1.6 | 21.7 | 2.6 | 38.7 | 3.0 | 31.5 | 1.5 |
| Hs|NM_033360.2|204 | 204 | 217 | 1 | 92.7 | 11.5 | 107.2 | 11.4 | 109.3 | 5.4 | 96.7 | 13.5 |
| Hs|NM_033360.2|205 | 205 | 218 | 1 | 105.3 | 7.7 | 127.7 | 5.6 | 108.2 | 3.3 | 94.9 | 4.5 |
| Hs|NM_033360.2|206 | 206 | 219 | 1 | 67.1 | 4.7 | 80.9 | 10.9 | 71.9 | 1.6 | 59.3 | 2.6 |
| Hs|NM_033360.2|207 | 207 | 220 | 1 | 46.0 | N/A | 62.7 | N/A | 63.1 | 5.9 | 55.8 | 5.8 |
| Hs|NM_033360.2|208 | 208 | 221 | 1 | 54.6 | 10.4 | 47.3 | 14.6 | 53.4 | 1.9 | 59.0 | 1.9 |
| Hs|NM_033360.2|209 | 209 | 222 | 1 | 83.2 | 3.4 | 90.4 | 4.2 | 89.5 | 6.1 | 90.8 | 4.1 |
| Hs|NM_033360.2|210 | 210 | 223 | 1 | 78.1 | 5.2 | 89.9 | 5.6 | 96.4 | 1.3 | 88.2 | 2.9 |
| Hs|NM_033360.2|241 | 241 | 254 | 1 | 14.5 | 10.8 | 22.4 | 4.9 | 42.6 | 5.9 | 36.4 | 3.8 |
| Hs|NM_033360.2|313 | 313 | 326 | 1 | 32.2 | 6.7 | 51.5 | 3.7 | 63.1 | 5.6 | 53.8 | 4.4 |
| Hs|NM_033360.2|314 | 314 | 327 | 1 | 34.2 | 6.8 | 46.6 | 10.0 | 66.6 | 3.3 | 56.2 | 3.6 |
| Hs|NM_033360.2|318 | 318 | 331 | 1 | 10.9 | 9.2 | 27.6 | 6.8 | 43.0 | 10.4 | 30.3 | 9.0 |
| Hs|NM_033360.2|328 | 328 | 341 | 1 | 25.1 | 5.8 | 28.1 | 6.8 | 47.6 | 6.4 | 36.2 | 3.1 |

TABLE 9-continued

KRAS Inhibitory Efficacy of Table 8 DsiRNAs Assayed at 1 nM in Human HeLa and Mouse Hepa 1-6 Cells

| | | | | Human - HeLa Normalized HPRT/SFRS9; vs NC1, NC5, NC7 | | | | Mouse - Hepa 1-6 Normalized HPRT/Rpl23; vs NC1, NC5, NC7 | | | |
|---|---|---|---|---|---|---|---|---|---|---|---|
| | | | | Assay: Hs KRAS 268-385 (MAX) | | Assay: Hs KRAS 3393-3516 (FAM) | | Assay: Mm KRAS 279-390 (MAX) | | Assay: Mm KRAS 1064-1161 (FAM) | |
| Name | Hs Loc | Mm Loc | nM | % Left Ave | % Error | % Left Ave | % Error | % Left Ave | % Error | % Left Ave | % Error |
| Hs\|NM_033360.2\|330 | 330 | 343 | 1 | 10.3 | 5.5 | 17.2 | 8.0 | 26.2 | 3.5 | 25.0 | 6.1 |
| Hs\|NM_033360.2\|331 | 331 | 344 | 1 | 15.1 | 6.2 | 27.0 | 7.4 | 44.0 | 6.0 | 37.2 | 6.0 |
| Hs\|NM_033360.2\|332 | 332 | 345 | 1 | 20.8 | 9.6 | 40.2 | 5.8 | 45.7 | 11.0 | 38.0 | 5.4 |
| Hs\|NM_033360.2\|333 | 333 | 346 | 1 | 19.4 | 3.8 | 38.6 | 3.8 | 47.2 | 5.9 | 36.3 | 3.4 |
| Hs\|NM_033360.2\|334 | 334 | 347 | 1 | 7.6 | 5.2 | 29.6 | 3.2 | 35.6 | 3.3 | 28.8 | 5.8 |
| Hs\|NM_033360.2\|335 | 335 | 348 | 1 | 28.0 | 10.3 | 41.2 | 16.6 | 72.8 | 6.5 | 55.2 | 10.7 |
| Hs\|NM_033360.2\|336 | 336 | 349 | 1 | 16.5 | 9.3 | 31.9 | 1.1 | 57.0 | 4.0 | 41.7 | 2.6 |
| Hs\|NM_033360.2\|352 | 352 | 365 | 1 | 15.7 | 7.0 | 29.5 | 2.2 | 64.9 | 6.1 | 43.3 | 4.6 |
| Hs\|NM_033360.2\|353 | 353 | 366 | 1 | 7.2 | 5.6 | 26.1 | 7.0 | 35.7 | 10.8 | 26.3 | 5.7 |
| Hs\|NM_033360.2\|354 | 354 | 367 | 1 | 15.3 | 3.8 | 42.4 | 3.9 | 57.1 | 1.6 | 41.8 | 2.6 |
| Hs\|NM_033360.2\|364 | 364 | 377 | 1 | 31.3 | 1.8 | 44.3 | 6.2 | 57.1 | 2.6 | 47.8 | 3.9 |
| Hs\|NM_033360.2\|365 | 365 | 378 | 1 | 10.0 | 13.3 | 23.1 | 5.8 | 38.8 | 2.1 | 28.3 | 6.4 |
| Hs\|NM_033360.2\|366 | 366 | 379 | 1 | 11.1 | 8.0 | 27.1 | 8.3 | 44.3 | 5.4 | 28.7 | 2.5 |
| Hs\|NM_033360.2\|367 | 367 | 380 | 1 | 14.6 | 11.3 | 37.3 | 8.7 | 58.4 | 3.2 | 34.5 | 5.2 |
| Hs\|NM_033360.2\|368 | 368 | 381 | 1 | 54.4 | 2.6 | 81.7 | 11.4 | 113.2 | 9.3 | 81.6 | 8.6 |
| Hs\|NM_033360.2\|369 | 369 | 382 | 1 | 73.5 | N/A | 83.8 | N/A | 104.8 | 27.8 | 90.3 | 9.3 |
| Hs\|NM_033360.2\|370 | 370 | 383 | 1 | 56.7 | 3.8 | 61.9 | 5.0 | 69.0 | 3.2 | 66.4 | 1.8 |
| Hs\|NM_033360.2\|371 | 371 | 384 | 1 | 12.7 | 9.4 | 22.7 | 8.8 | 47.4 | 2.8 | 42.2 | 3.8 |
| Hs\|NM_033360.2\|372 | 372 | 385 | 1 | 26.6 | 7.9 | 63.7 | 12.0 | 75.0 | 3.0 | 49.2 | 4.3 |
| Hs\|NM_033360.2\|420 | 420 | 433 | 1 | 11.8 | 11.9 | 21.5 | 10.5 | 39.9 | 5.0 | 31.5 | 4.1 |
| Hs\|NM_033360.2\|421 | 421 | 434 | 1 | 40.7 | 10.6 | 55.4 | 13.0 | 72.0 | 8.5 | 59.6 | 7.7 |
| Hs\|NM_033360.2\|422 | 422 | 435 | 1 | 18.1 | 13.3 | 30.2 | 18.8 | 41.8 | 5.8 | 32.1 | 11.0 |
| Hs\|NM_033360.2\|423 | 423 | 436 | 1 | 18.6 | 14.2 | 27.2 | 13.4 | 52.3 | 7.6 | 40.5 | 5.0 |
| Hs\|NM_033360.2\|424 | 424 | 437 | 1 | 10.8 | 14.3 | 24.3 | 7.7 | 31.6 | 12.7 | 24.4 | 3.0 |
| Hs\|NM_033360.2\|425 | 425 | 438 | 1 | 10.2 | 6.6 | 16.7 | 10.6 | 26.1 | 4.5 | 27.0 | 4.9 |
| Hs\|NM_033360.2\|426 | 426 | 439 | 1 | 10.4 | 13.1 | 22.7 | 10.6 | 32.0 | 3.9 | 28.9 | 4.5 |
| Hs\|NM_033360.2\|436 | 436 | 449 | 1 | 9.6 | 11.4 | 19.2 | 6.5 | 37.6 | 5.9 | 33.4 | 4.7 |
| Hs\|NM_033360.2\|437 | 437 | 450 | 1 | 22.8 | 5.2 | 32.9 | 5.2 | 53.6 | 5.4 | 46.2 | 5.2 |
| Hs\|NM_033360.2\|438 | 438 | 451 | 1 | 11.0 | 9.4 | 18.6 | 3.9 | 34.5 | 1.7 | 26.7 | 3.8 |
| Hs\|NM_033360.2\|439 | 439 | 452 | 1 | 14.0 | 15.4 | 18.6 | 11.3 | 40.5 | 4.6 | 28.6 | 4.5 |
| Hs\|NM_033360.2\|440 | 440 | 453 | 1 | 12.6 | 2.2 | 22.8 | 4.4 | 43.1 | 4.5 | 33.9 | 5.3 |
| Hs\|NM_033360.2\|441 | 441 | 454 | 1 | 10.9 | 11.6 | 20.7 | 8.9 | 40.1 | 8.9 | 28.7 | 2.7 |
| Hs\|NM_033360.2\|442 | 442 | 455 | 1 | 16.8 | 2.1 | 23.4 | 4.0 | 37.1 | 5.9 | 37.3 | 9.2 |
| Hs\|NM_033360.2\|443 | 443 | 456 | 1 | 17.2 | 8.9 | 26.9 | 6.6 | 47.5 | 2.4 | 45.8 | 3.7 |
| Hs\|NM_033360.2\|444 | 444 | 457 | 1 | 13.3 | 6.7 | 20.0 | 1.9 | 35.1 | 3.2 | 32.3 | 2.7 |
| Hs\|NM_033360.2\|454 | 454 | 467 | 1 | 8.4 | 6.5 | 18.2 | 8.4 | 42.5 | 4.3 | 33.7 | 4.4 |
| Hs\|NM_033360.2\|455 | 455 | 468 | 1 | 11.7 | 7.0 | 19.9 | 5.0 | 44.2 | 10.4 | 41.5 | 3.1 |
| Hs\|NM_033360.2\|456 | 456 | 469 | 1 | 13.0 | 6.4 | 24.6 | 1.6 | 42.8 | 3.4 | 30.9 | 6.4 |
| Hs\|NM_033360.2\|457 | 457 | 470 | 1 | 10.8 | 7.7 | 21.4 | 1.3 | 43.4 | 8.2 | 32.7 | 3.4 |
| Hs\|NM_033360.2\|458 | 458 | 471 | 1 | 13.7 | 3.5 | 15.2 | 19.2 | 37.0 | 2.9 | 28.6 | 8.7 |
| Hs\|NM_033360.2\|459 | 459 | 472 | 1 | 11.5 | 9.3 | 14.8 | 2.4 | 31.8 | 1.5 | 32.1 | 3.0 |
| Hs\|NM_033360.2\|460 | 460 | 473 | 1 | 5.0 | 12.7 | 11.3 | 9.3 | 37.2 | 0.2 | 32.7 | 2.1 |
| Hs\|NM_033360.2\|461 | 461 | 474 | 1 | 7.6 | 9.6 | 12.7 | 8.5 | 31.6 | 1.5 | 28.1 | 2.9 |
| Hs\|NM_033360.2\|462 | 462 | 475 | 1 | 6.8 | 14.3 | 14.1 | 7.6 | 33.3 | 3.2 | 27.8 | 3.2 |
| Hs\|NM_033360.2\|508 | 508 | h534 | 1 | 16.8 | 6.6 | 22.8 | 14.8 | 102.3 | 9.0 | 79.5 | 8.1 |
| Hs\|NM_033360.2\|531 | 531 | 544 | 1 | 31.4 | 2.1 | 36.0 | 5.0 | 63.9 | 3.4 | 62.9 | 20.1 |
| Hs\|NM_033360.2\|532 | 532 | 545 | 1 | 16.2 | 7.1 | 22.6 | 7.5 | 43.0 | 4.9 | 33.2 | 4.2 |
| Hs\|NM_033360.2\|534 | 534 | 547 | 1 | 15.5 | 3.7 | 20.7 | 3.8 | 44.8 | 4.4 | 35.1 | 8.6 |
| Hs\|NM_033360.2\|586 | 586 | h612 | 1 | 9.4 | 4.3 | 11.8 | 4.9 | 86.3 | 7.2 | 91.3 | 7.9 |
| Hs\|NM_033360.2\|587 | 587 | h613 | 1 | 20.1 | 4.6 | 30.6 | 4.5 | 102.6 | 1.7 | 103.2 | 2.4 |
| Hs\|NM_033360.2\|588 | 588 | h614 | 1 | 22.0 | 9.3 | 23.9 | 13.9 | 104.1 | 14.0 | 104.4 | 9.8 |
| Hs\|NM_033360.2\|763 | 763 | 652 | 1 | 16.4 | 6.0 | 20.3 | 4.8 | 42.6 | 1.6 | 37.9 | 2.1 |
| Hs\|NM_033360.2\|764 | 764 | 653 | 1 | 15.9 | 4.2 | 21.3 | 3.4 | 36.8 | 6.2 | 32.9 | 5.4 |
| Hs\|NM_033360.2\|784 | 784 | 673 | 1 | 8.5 | 2.8 | 13.3 | 5.9 | 31.7 | 15.4 | 25.2 | 17.6 |
| Hs\|NM_033360.2\|794 | 794 | 683 | 1 | 11.4 | 8.4 | 18.1 | 7.7 | 31.9 | 9.8 | 24.8 | 7.9 |
| Hs\|NM_033360.2\|795 | 795 | 684 | 1 | 10.4 | 6.7 | 13.9 | 2.5 | 27.7 | 7.0 | 23.2 | 7.2 |
| Hs\|NM_033360.2\|796 | 796 | 685 | 1 | 30.5 | 2.0 | 33.2 | 2.0 | 25.3 | N/A | 37.8 | N/A |
| Hs\|NM_033360.2\|797 | 797 | 686 | 1 | 12.7 | 2.3 | 20.9 | 3.5 | 23.2 | 1.8 | 29.6 | 2.4 |
| Hs\|NM_033360.2\|798 | 798 | 687 | 1 | 11.0 | 11.3 | 28.2 | 9.3 | 27.5 | 4.1 | 35.4 | 2.2 |
| Hs\|NM_033360.2\|799 | 799 | 688 | 1 | 8.7 | 8.4 | 16.7 | 4.7 | 119.5 | 1.7 | 100.7 | 4.1 |
| Hs\|NM_033360.2\|800 | 800 | 689 | 1 | 13.6 | 7.4 | 19.3 | 6.7 | 144.8 | 21.8 | 105.1 | 7.8 |
| Hs\|NM_033360.2\|801 | 801 | 690 | 1 | 28.5 | 5.8 | 40.8 | 5.8 | 37.0 | 5.3 | 40.8 | 4.9 |
| Hs\|NM_033360.2\|802 | 802 | 691 | 1 | 13.9 | 4.6 | 37.2 | 2.0 | 152.1 | 2.9 | 124.7 | 6.4 |
| Hs\|NM_033360.2\|908 | 908 | h810 | 1 | 21.4 | 12.6 | 17.4 | 13.1 | 130.7 | 7.5 | 117.6 | 5.3 |
| Hs\|NM_033360.2\|909 | 909 | h811 | 1 | 11.6 | 2.0 | 9.0 | 7.7 | 90.4 | 2.6 | 100.0 | 2.6 |
| Hs\|NM_033360.2\|920 | 920 | 807 | 1 | 15.9 | 7.1 | 14.1 | 11.6 | 110.8 | 4.6 | 107.1 | 4.4 |
| Hs\|NM_033360.2\|921 | 921 | 808 | 1 | 15.5 | 9.3 | 18.4 | 11.9 | 118.2 | 11.7 | 108.9 | 9.8 |
| Hs\|NM_033360.2\|922 | 922 | 809 | 1 | 14.3 | 8.5 | 13.2 | 6.5 | 135.9 | 4.6 | 110.9 | 6.5 |
| Hs\|NM_033360.2\|923 | 923 | 810 | 1 | 17.3 | 8.7 | 12.6 | 12.0 | 129.0 | 2.2 | 106.2 | 5.2 |

TABLE 9-continued

KRAS Inhibitory Efficacy of Table 8 DsiRNAs Assayed at 1 nM in Human HeLa and Mouse Hepa 1-6 Cells

| | | | | Human - HeLa Normalized HPRT/SFRS9; vs NC1, NC5, NC7 | | | | Mouse - Hepa 1-6 Normalized HPRT/Rpl23; vs NC1, NC5, NC7 | | | |
|---|---|---|---|---|---|---|---|---|---|---|---|
| | | | | Assay: Hs KRAS 268-385 (MAX) | | Assay: Hs KRAS 3393-3516 (FAM) | | Assay: Mm KRAS 279-390 (MAX) | | Assay: Mm KRAS 1064-1161 (FAM) | |
| Name | Hs Loc | Mm Loc | nM | % Left Ave | % Error | % Left Ave | % Error | % Left Ave | % Error | % Left Ave | % Error |
| Hs|NM_033360.2|924 | 924 | 811 | 1 | 19.6 | 3.1 | 20.7 | 8.8 | 111.5 | 8.5 | 100.9 | 7.4 |
| Hs|NM_033360.2|925 | 925 | 812 | 1 | 22.2 | 6.0 | 28.8 | 8.6 | 115.3 | 3.2 | 99.8 | 1.7 |
| Hs|NM_033360.2|926 | 926 | 813 | 1 | 21.2 | 23.3 | 27.7 | 8.6 | 114.7 | 18.4 | 124.1 | 5.8 |
| Hs|NM_033360.2|927 | 927 | 814 | 1 | 15.6 | 10.3 | 10.7 | 1.7 | 99.2 | 7.3 | 103.9 | 6.7 |
| Hs|NM_033360.2|928 | 928 | 815 | 1 | 26.1 | 4.7 | 21.6 | 3.0 | 118.0 | 4.4 | 111.7 | 5.3 |
| Hs|NM_033360.2|938 | 938 | 825 | 1 | 26.0 | 7.2 | 22.1 | 17.7 | 106.2 | 9.8 | 107.7 | 6.9 |
| Hs|NM_033360.2|939 | 939 | 826 | 1 | 13.9 | 3.9 | 13.9 | 11.1 | 30.9 | 8.9 | 32.2 | 10.9 |
| Hs|NM_033360.2|940 | 940 | 827 | 1 | 19.7 | 6.4 | 22.2 | 8.2 | 28.0 | 7.0 | 34.2 | 4.8 |
| Hs|NM_033360.2|941 | 941 | 828 | 1 | 13.8 | 9.7 | 15.0 | 12.2 | 26.0 | 17.1 | 29.5 | 15.2 |
| Hs|NM_033360.2|942 | 942 | 829 | 1 | 15.9 | 2.8 | 18.3 | 7.0 | 50.1 | 5.8 | 48.2 | 2.3 |
| Hs|NM_033360.2|943 | 943 | 830 | 1 | 22.8 | N/A | 25.1 | N/A | 128.1 | 3.3 | 113.3 | 7.6 |
| Hs|NM_033360.2|944 | 944 | 831 | 1 | 22.1 | 11.4 | 15.7 | 7.2 | 45.5 | 3.8 | 44.1 | 2.3 |
| Hs|NM_033360.2|945 | 945 | 832 | 1 | 15.6 | 8.3 | 12.7 | 8.1 | 32.7 | 2.2 | 29.4 | 2.8 |
| Hs|NM_033360.2|946 | 946 | 833 | 1 | 13.7 | 7.4 | 12.9 | 2.5 | 29.7 | 2.3 | 25.8 | 4.4 |
| Hs|NM_033360.2|1010 | 1010 | h912 | 1 | 20.6 | 3.6 | 22.6 | 1.6 | 22.8 | 4.5 | 17.2 | 3.7 |
| Hs|NM_033360.2|1012 | 1012 | h914 | 1 | 24.4 | N/A | 28.3 | N/A | 29.9 | 8.6 | 23.3 | 9.1 |
| Hs|NM_033360.2|1045 | 1045 | 936 | 1 | 18.3 | 10.7 | 19.3 | 6.7 | 52.5 | 4.3 | 42.0 | 3.1 |
| Hs|NM_033360.2|1197 | 1197 | h1099 | 1 | 12.2 | 8.9 | 11.6 | 8.4 | 30.4 | 6.3 | 24.5 | 3.1 |
| Hs|NM_033360.2|1198 | 1198 | h1100 | 1 | 17.3 | 12.1 | 12.8 | 5.8 | 138.8 | 11.4 | 114.9 | 18.5 |
| Hs|NM_033360.2|1230 | 1230 | h1132 | 1 | 18.4 | 12.0 | 11.6 | 12.5 | 75.1 | 1.5 | 83.5 | 1.2 |
| Hs|NM_033360.2|1231 | 1231 | h1133 | 1 | 16.7 | 7.1 | 12.7 | 5.0 | 20.5 | 8.2 | 26.0 | 6.3 |
| Hs|NM_033360.2|1234 | 1234 | h1136 | 1 | 21.9 | 4.0 | 16.4 | 3.0 | 24.3 | 8.6 | 26.6 | 10.3 |
| Hs|NM_033360.2|1249 | 1249 | h1151 | 1 | 20.1 | 1.5 | 12.0 | 1.8 | 20.9 | 3.9 | 22.9 | 6.1 |
| Hs|NM_033360.2|1250 | 1250 | h1152 | 1 | 26.2 | 6.7 | 21.0 | 7.3 | 27.4 | 5.8 | 30.8 | 7.0 |
| Hs|NM_033360.2|1287 | 1287 | h1189 | 1 | 44.3 | 6.8 | 40.1 | 4.3 | 30.1 | 6.5 | 31.2 | 6.6 |
| Hs|NM_033360.2|1527 | 1527 | h1429 | 1 | 34.0 | 2.7 | 17.3 | 5.7 | 40.8 | 4.1 | 41.0 | 3.5 |
| Hs|NM_033360.2|1533 | 1533 | h1435 | 1 | 25.6 | 17.6 | 15.4 | 4.8 | 33.7 | 8.8 | 49.1 | 21.9 |
| Hs|NM_033360.2|1540 | 1540 | h1442 | 1 | 25.6 | 6.2 | 11.4 | 5.6 | 18.3 | 15.2 | 26.9 | 11.0 |
| Hs|NM_033360.2|1541 | 1541 | h1443 | 1 | 25.2 | 4.7 | 9.8 | 6.2 | 40.3 | 9.4 | 48.6 | 6.5 |
| Hs|NM_033360.2|1542 | 1542 | h1444 | 1 | 41.4 | 5.6 | 32.1 | 7.2 | 32.0 | 7.8 | 34.4 | 15.7 |
| Hs|NM_033360.2|1583 | 1583 | 1435 | 1 | 22.5 | 4.3 | 13.3 | 2.1 | 23.3 | 9.6 | 25.1 | 9.6 |
| Hs|NM_033360.2|1584 | 1584 | 1436 | 1 | 32.7 | 2.0 | 24.5 | 3.1 | 28.1 | 4.1 | 29.0 | 4.1 |
| Hs|NM_033360.2|1585 | 1585 | 1437 | 1 | 32.9 | 7.8 | 22.2 | 9.7 | 16.6 | 10.1 | 18.5 | 11.7 |
| Hs|NM_033360.2|1586 | 1586 | 1438 | 1 | 52.5 | 2.5 | 36.2 | 6.1 | 23.8 | 7.2 | 26.0 | 3.6 |
| Hs|NM_033360.2|1597 | 1597 | h1499 | 1 | 38.2 | N/A | 36.1 | N/A | 29.3 | 7.6 | 31.1 | 3.9 |
| Hs|NM_033360.2|1606 | 1606 | h1508 | 1 | 45.4 | 5.0 | 28.5 | 4.2 | 110.9 | 2.9 | 119.3 | 2.0 |
| Hs|NM_033360.2|1630 | 1630 | 1471 | 1 | 23.2 | 8.0 | 16.5 | 8.1 | 26.8 | 7.3 | 34.7 | 4.8 |
| Hs|NM_033360.2|1631 | 1631 | 1472 | 1 | 35.4 | 5.2 | 23.6 | 5.7 | 37.1 | 4.6 | 44.0 | 4.2 |
| Hs|NM_033360.2|1632 | 1632 | 1473 | 1 | 26.9 | 2.3 | 20.0 | 1.6 | 29.8 | 4.3 | 32.8 | 1.8 |
| Hs|NM_033360.2|1633 | 1633 | 1474 | 1 | 25.4 | 5.8 | 24.4 | 13.4 | 31.6 | 3.4 | 38.9 | 7.6 |
| Hs|NM_033360.2|1634 | 1634 | 1475 | 1 | 27.8 | 3.5 | 20.3 | 3.6 | 28.5 | 5.9 | 31.6 | 5.3 |
| Hs|NM_033360.2|1635 | 1635 | 1476 | 1 | 29.8 | 0.4 | 23.2 | 3.4 | 37.4 | 4.9 | 38.7 | 4.7 |
| Hs|NM_033360.2|1636 | 1636 | 1477 | 1 | 51.0 | 22.3 | 38.9 | 11.1 | 63.5 | 11.6 | 65.0 | 6.7 |
| Hs|NM_033360.2|1637 | 1637 | 1478 | 1 | 31.5 | 7.4 | 14.0 | 11.9 | 28.2 | 6.0 | 37.3 | 6.0 |
| Hs|NM_033360.2|1638 | 1638 | 1479 | 1 | 31.1 | 1.4 | 27.4 | 2.5 | 44.1 | 8.9 | 51.8 | 3.0 |
| Hs|NM_033360.2|1639 | 1639 | 1480 | 1 | 47.7 | 4.9 | 26.0 | 7.7 | 57.0 | 3.2 | 60.9 | 2.6 |
| Hs|NM_033360.2|1640 | 1640 | 1481 | 1 | 35.1 | 3.7 | 17.7 | 4.2 | 62.1 | 2.6 | 59.9 | 3.7 |
| Hs|NM_033360.2|1736 | 1736 | h1638 | 1 | 30.9 | 3.9 | 20.2 | 7.0 | 133.0 | 2.5 | 110.1 | 1.7 |
| Hs|NM_033360.2|1741 | 1741 | h1643 | 1 | 25.2 | 9.1 | 12.4 | 7.0 | 126.6 | 0.8 | 111.7 | 4.0 |
| Hs|NM_033360.2|1742 | 1742 | h1644 | 1 | 18.5 | 4.4 | 11.5 | 6.7 | 130.1 | 4.7 | 106.9 | 4.9 |
| Hs|NM_033360.2|1753 | 1753 | h1655 | 1 | 33.4 | 15.2 | 29.9 | 5.2 | 130.3 | 3.4 | 105.4 | 2.0 |
| Hs|NM_033360.2|1754 | 1754 | h1656 | 1 | 31.3 | 5.8 | 14.6 | 16.3 | 93.9 | 4.7 | 100.7 | 4.6 |
| Hs|NM_033360.2|1769 | 1769 | h1671 | 1 | 25.7 | 4.9 | 18.4 | 11.5 | 107.6 | 4.2 | 129.9 | 14.3 |
| Hs|NM_033360.2|1771 | 1771 | h1673 | 1 | 31.4 | 3.1 | 13.9 | 9.0 | 106.8 | 12.2 | 100.8 | 8.5 |
| Hs|NM_033360.2|1772 | 1772 | h1674 | 1 | 24.5 | 3.5 | 13.2 | 5.0 | 111.3 | 1.0 | 95.3 | 2.4 |
| Hs|NM_033360.2|1783 | 1783 | h1685 | 1 | 31.3 | 2.2 | 27.9 | 11.1 | 126.6 | 4.0 | 109.3 | 5.4 |
| Hs|NM_033360.2|1784 | 1784 | h1686 | 1 | 33.6 | 16.9 | 22.0 | 20.9 | 121.4 | 15.0 | 98.0 | 15.2 |
| Hs|NM_033360.2|1785 | 1785 | h1687 | 1 | 28.2 | 4.9 | 19.9 | 5.0 | 124.1 | 2.2 | 105.5 | 5.3 |
| Hs|NM_033360.2|1799 | 1799 | h1701 | 1 | 23.0 | 6.1 | 15.1 | 8.4 | 128.6 | 1.8 | 106.8 | 2.8 |
| Hs|NM_033360.2|2100 | 2100 | h2002 | 1 | 49.7 | 19.4 | 34.1 | 12.1 | 106.3 | 5.6 | 111.4 | 2.7 |
| Hs|NM_033360.2|2134 | 2134 | h2036 | 1 | 51.2 | N/A | 35.0 | N/A | 130.2 | 3.6 | 119.6 | 4.9 |
| Hs|NM_033360.2|2216 | 2216 | h2118 | 1 | 28.4 | 4.6 | 13.2 | 6.6 | 113.2 | 2.8 | 114.0 | 2.6 |
| Hs|NM_033360.2|2217 | 2217 | h2119 | 1 | 23.6 | 6.9 | 11.2 | 12.2 | 127.0 | 1.7 | 111.9 | 1.8 |
| Hs|NM_033360.2|2218 | 2218 | h2120 | 1 | 30.7 | 13.0 | 16.3 | 11.9 | 119.3 | 2.4 | 106.3 | 7.2 |
| Hs|NM_033360.2|2229 | 2229 | h2131 | 1 | 34.4 | 6.7 | 16.0 | 6.5 | 118.3 | 3.9 | 110.1 | 8.9 |
| Hs|NM_033360.2|2247 | 2247 | h2149 | 1 | 31.2 | 6.8 | 18.1 | 10.6 | 129.1 | 6.1 | 117.7 | 6.2 |
| Hs|NM_033360.2|2326 | 2326 | h2228 | 1 | 85.1 | 24.0 | 118.0 | 25.0 | 170.9 | 9.9 | 151.3 | 16.5 |
| Hs|NM_033360.2|2327 | 2327 | h2229 | 1 | 105.3 | 4.8 | 76.9 | 2.9 | 106.7 | 1.1 | 108.6 | 6.0 |
| Hs|NM_033360.2|2547 | 2547 | 2285 | 1 | 68.5 | 3.8 | 41.4 | 1.8 | 98.3 | 6.3 | 102.5 | 2.4 |

TABLE 9-continued

KRAS Inhibitory Efficacy of Table 8 DsiRNAs Assayed at 1 nM in Human HeLa and Mouse Hepa 1-6 Cells

| | | | | Human - HeLa Normalized HPRT/SFRS9; vs NC1, NC5, NC7 | | | | Mouse - Hepa 1-6 Normalized HPRT/Rpl23; vs NC1, NC5, NC7 | | | |
|---|---|---|---|---|---|---|---|---|---|---|---|
| | | | | Assay: Hs KRAS 268-385 (MAX) | | Assay: Hs KRAS 3393-3516 (FAM) | | Assay: Mm KRAS 279-390 (MAX) | | Assay: Mm KRAS 1064-1161 (FAM) | |
| Name | Hs Loc | Mm Loc | nM | % Left Ave | % Error | % Left Ave | % Error | % Left Ave | % Error | % Left Ave | % Error |
| Hs\|NM_033360.2\|2548 | 2548 | 2286 | 1 | 50.0 | 6.7 | 30.2 | 12.6 | 85.8 | 3.2 | 80.3 | 3.1 |
| Hs\|NM_033360.2\|3741 | 3741 | h3643 | 1 | 51.3 | 21.2 | 51.4 | 10.6 | 110.0 | 2.5 | 97.0 | 2.8 |
| Hs\|NM_033360.2\|3746 | 3746 | h3648 | 1 | 49.6 | 10.5 | 41.6 | 11.3 | 129.2 | 8.7 | 116.8 | 9.0 |
| Hs\|NM_033360.2\|3747 | 3747 | h3649 | 1 | 42.3 | 3.9 | 39.2 | 3.2 | 115.5 | 1.5 | 105.8 | 1.7 |
| Hs\|NM_033360.2\|3783 | 3783 | h3685 | 1 | 36.2 | 4.3 | 31.1 | 4.7 | 119.2 | 2.3 | 108.7 | 1.3 |
| Hs\|NM_033360.2\|3784 | 3784 | h3686 | 1 | 78.0 | 20.4 | 42.2 | 11.3 | 141.2 | 6.9 | 125.0 | 1.4 |
| Hs\|NM_033360.2\|3810 | 3810 | h3712 | 1 | 56.0 | 18.6 | 39.7 | 19.3 | 91.2 | 1.6 | 102.4 | 2.5 |
| Hs\|NM_033360.2\|4396 | 4396 | 3584 | 1 | 58.6 | 2.6 | 48.2 | 2.0 | 88.8 | 3.1 | 94.0 | 2.2 |
| Hs\|NM_033360.2\|4447 | 4447 | 3633 | 1 | 65.1 | 3.6 | 49.0 | 1.9 | 78.4 | 9.3 | 76.4 | 9.6 |
| Hs\|NM_033360.2\|4448 | 4448 | 3634 | 1 | 41.7 | 3.1 | 31.5 | 8.6 | 98.3 | 4.5 | 86.0 | 4.2 |
| Hs\|NM_033360.2\|4449 | 4449 | 3635 | 1 | 57.3 | 11.0 | 54.8 | 10.9 | 108.2 | 7.1 | 92.5 | 5.0 |
| Hs\|NM_033360.2\|4450 | 4450 | 3636 | 1 | 55.8 | 7.5 | 54.7 | 6.3 | 87.6 | 7.5 | 75.0 | 9.4 |
| Hs\|NM_033360.2\|4451 | 4451 | 3637 | 1 | 76.7 | 3.5 | 74.5 | 3.8 | 106.1 | 1.1 | 88.3 | 2.3 |
| Hs\|NM_033360.2\|4452 | 4452 | 3638 | 1 | 56.1 | 2.1 | 50.0 | 4.1 | 109.4 | 4.5 | 94.8 | 5.9 |
| Hs\|NM_033360.2\|4748 | 4748 | 3940 | 1 | 54.7 | 13.7 | 41.7 | 10.8 | 89.1 | 0.9 | 97.6 | 1.0 |
| Hs\|NM_033360.2\|4749 | 4749 | 3941 | 1 | 52.3 | 13.5 | 41.0 | 9.5 | 109.1 | 5.4 | 109.6 | 4.0 |
| Hs\|NM_033360.2\|4878 | 4878 | 4082 | 1 | 63.9 | 4.5 | 63.1 | 5.1 | 116.7 | 7.2 | 104.9 | 7.1 |
| Hs\|NM_033360.2\|4879 | 4879 | 4083 | 1 | 43.5 | 4.1 | 41.3 | 2.3 | 117.8 | 4.3 | 102.2 | 4.2 |
| Hs\|NM_033360.2\|4880 | 4880 | 4084 | 1 | 64.1 | 10.5 | 75.7 | 12.4 | 119.1 | 3.4 | 100.4 | 5.1 |
| Hs\|NM_033360.2\|5073 | 5073 | 4259 | 1 | 36.8 | 4.0 | 36.1 | 7.2 | 116.2 | 2.9 | 106.8 | 5.9 |
| Hs\|NM_033360.2\|5074 | 5074 | 4260 | 1 | 45.0 | 3.6 | 58.5 | 3.0 | 148.1 | 7.0 | 129.1 | 6.9 |
| Hs\|NM_033360.2\|5075 | 5075 | 4261 | 1 | 48.5 | 2.6 | 53.1 | 6.6 | | | | |
| Hs\|NM_033360.2\|5076 | 5076 | 4262 | 1 | 38.4 | 9.2 | 29.4 | 10.6 | 83.3 | N/A | 90.7 | N/A |
| Hs\|NM_033360.2\|5077 | 5077 | 4263 | 1 | 32.9 | 6.0 | 29.1 | 4.0 | 91.5 | 4.8 | 91.2 | 3.5 |
| Hs\|NM_033360.2\|5078 | 5078 | 4264 | 1 | 29.7 | 7.8 | 28.6 | 6.7 | 99.1 | 2.6 | 95.2 | 1.1 |
| Hs\|NM_033360.2\|5128 | 5128 | 4314 | 1 | 56.7 | 4.6 | 62.4 | 5.3 | 108.3 | 3.9 | 91.6 | 4.6 |
| Hs\|NM_033360.2\|5129 | 5129 | 4315 | 1 | 54.7 | 5.3 | 61.6 | 6.4 | 110.3 | 9.6 | 91.4 | 9.8 |
| Hs\|NM_033360.2\|5138 | 5138 | 4324 | 1 | 38.2 | 6.5 | 42.1 | 5.6 | 102.6 | 6.7 | 96.3 | 7.8 |
| Hs\|NM_033360.2\|5139 | 5139 | 4325 | 1 | 31.5 | 7.1 | 35.6 | 9.6 | 101.4 | 0.9 | 89.0 | 2.7 |
| Hs\|NM_033360.2\|5140 | 5140 | 4326 | 1 | 47.1 | 21.2 | 40.8 | 15.3 | 114.9 | 2.9 | 96.7 | 5.7 |
| Hs\|NM_033360.2\|5141 | 5141 | 4327 | 1 | 48.6 | 4.8 | 41.9 | 5.7 | 76.3 | 2.9 | 82.6 | 3.1 |
| Hs\|NM_033360.2\|5142 | 5142 | 4328 | 1 | 60.3 | 16.7 | 54.1 | 17.5 | 95.4 | 1.1 | 90.9 | 1.4 |
| Hs\|NM_033360.2\|5143 | 5143 | 4329 | 1 | 42.2 | 7.7 | 42.5 | 10.0 | 89.2 | 7.9 | 84.5 | 4.0 |
| Hs\|NM_033360.2\|5163 | 5163 | 4349 | 1 | | | | | 109.7 | 2.4 | 94.3 | 2.1 |
| Hs\|NM_033360.2\|5164 | 5164 | 4350 | 1 | 34.5 | 6.4 | 37.5 | 6.1 | 94.7 | 3.6 | 79.5 | 5.3 |
| Hs\|NM_033360.2\|5167 | 5167 | 4353 | 1 | 49.4 | 9.8 | 54.7 | 11.0 | 89.9 | 12.2 | 76.5 | 14.1 |
| Hs\|NM_033360.2\|5168 | 5168 | 4354 | 1 | 46.9 | 2.4 | 54.3 | 5.4 | 111.9 | 3.8 | 95.9 | 1.5 |
| Hs\|NM_033360.2\|5169 | 5169 | 4355 | 1 | 52.8 | 3.3 | 52.1 | 4.9 | 113.7 | 3.1 | 99.7 | 2.8 |
| Hs\|NM_033360.2\|5170 | 5170 | 4356 | 1 | 42.2 | 3.2 | 38.2 | 1.6 | 82.6 | 5.5 | 84.1 | 3.1 |
| Hs\|NM_033360.2\|5171 | 5171 | 4357 | 1 | 51.6 | 5.7 | 49.4 | 4.5 | 86.4 | 0.6 | 92.6 | 1.4 |
| Hs\|NM_033360.2\|5172 | 5172 | 4358 | 1 | 56.4 | 6.2 | 58.8 | 4.5 | 81.0 | 4.0 | 79.6 | 3.7 |
| Hs\|NM_033360.2\|5173 | 5173 | 4359 | 1 | 44.8 | 8.5 | 51.5 | 8.1 | 89.8 | 4.2 | 87.9 | 5.7 |
| Hs\|NM_033360.2\|5197 | 5197 | 4435 | 1 | 63.9 | 19.5 | 64.1 | 10.2 | 90.5 | 3.8 | 94.4 | 5.1 |
| Hs\|NM_033360.2\|5198 | 5198 | 4436 | 1 | 47.3 | 5.7 | 58.2 | 6.4 | 91.9 | 3.3 | 92.9 | 6.0 |
| Hs\|NM_033360.2\|5199 | 5199 | 4437 | 1 | 50.0 | 4.8 | 52.7 | 4.8 | 114.0 | 4.9 | 95.5 | 3.9 |
| Hs\|NM_033360.2\|5200 | 5200 | 4438 | 1 | 65.4 | N/A | 69.3 | N/A | 98.1 | 4.0 | 88.1 | 1.8 |
| Hs\|NM_033360.2\|5201 | 5201 | 4439 | 1 | 54.0 | 4.4 | 42.2 | 5.7 | 89.1 | 10.4 | 79.4 | 6.4 |
| Hs\|NM_033360.2\|5202 | 5202 | 4440 | 1 | 45.3 | 4.6 | 41.8 | 5.9 | 109.5 | 1.8 | 92.8 | 3.7 |
| Hs\|NM_033360.2\|5203 | 5203 | 4441 | 1 | 35.7 | 5.7 | 34.5 | 3.1 | 102.3 | 2.7 | 87.3 | 2.3 |
| Hs\|NM_033360.2\|5204 | 5204 | 4442 | 1 | 51.9 | 5.3 | 55.8 | 3.3 | 107.5 | 8.5 | 90.1 | 8.9 |
| Hs\|NM_033360.2\|5205 | 5205 | 4443 | 1 | 57.7 | 24.4 | 67.9 | 34.1 | 105.0 | 6.0 | 90.4 | 4.0 |
| Hs\|NM_033360.2\|5209 | 5209 | 4447 | 1 | 55.1 | 7.8 | 58.9 | 7.2 | 121.2 | 7.6 | 102.1 | 6.1 |
| Hs\|NM_033360.2\|5210 | 5210 | 4448 | 1 | 46.9 | 8.9 | 45.0 | 9.1 | 106.8 | 5.0 | 94.1 | 3.1 |
| Hs\|NM_033360.2\|5211 | 5211 | 4449 | 1 | 54.4 | 11.7 | 54.8 | 11.5 | 107.4 | 4.8 | 94.8 | 6.4 |
| Hs\|NM_033360.2\|5212 | 5212 | 4450 | 1 | 41.3 | 7.5 | 33.3 | 6.6 | 101.2 | 6.8 | 83.0 | 8.4 |
| Hs\|NM_033360.2\|5213 | 5213 | 4451 | 1 | 47.6 | 3.6 | 42.6 | 5.1 | 84.6 | 6.4 | 66.6 | 8.0 |
| Hs\|NM_033360.2\|5214 | 5214 | 4452 | 1 | 43.5 | 5.2 | 42.7 | 9.1 | 106.3 | 1.7 | 82.9 | 2.2 |
| Hs\|NM_033360.2\|5234 | 5234 | 4472 | 1 | 45.0 | 3.8 | 47.3 | 5.0 | 103.1 | 4.9 | 83.9 | 4.0 |
| Hs\|NM_033360.2\|5235 | 5235 | 4473 | 1 | 39.8 | 9.1 | 41.1 | 7.7 | 86.6 | 13.1 | 71.4 | 10.3 |
| Hs\|NM_033360.2\|5252 | 5252 | 4491 | 1 | 34.4 | 17.6 | 39.8 | 17.3 | 139.6 | 6.9 | 127.6 | 9.9 |
| Hs\|NM_033360.2\|5253 | 5253 | 4492 | 1 | 24.2 | 12.4 | 23.9 | 11.2 | | | | |
| Hs\|NM_033360.2\|5254 | 5254 | 4493 | 1 | 35.3 | 7.6 | 36.8 | 7.9 | 102.0 | 1.2 | 84.1 | 1.6 |
| Hs\|NM_033360.2\|5255 | 5255 | 4494 | 1 | 38.1 | 7.3 | 32.2 | 4.5 | 71.0 | 3.3 | 86.8 | 1.7 |
| Hs\|NM_033360.2\|5256 | 5256 | 4497 | 1 | 52.5 | 5.8 | 48.3 | 7.2 | 89.4 | 2.2 | 93.8 | 4.1 |
| Hs\|NM_033360.2\|5257 | 5257 | 4542 | 1 | 40.0 | 7.6 | 36.6 | 8.8 | 90.3 | 5.7 | 79.7 | 4.6 |
| Hs\|NM_033360.2\|5258 | 5258 | 4548 | 1 | 27.1 | 8.7 | 21.1 | 6.4 | 90.8 | 3.0 | 86.0 | 4.0 |
| Hs\|NM_033360.2\|5259 | 5259 | 4551 | 1 | 44.7 | 20.6 | 50.5 | 24.9 | 124.7 | 4.2 | 102.6 | 3.0 |
| Hs\|NM_033360.2\|5260 | 5260 | 4591 | 1 | 48.0 | 2.0 | 50.1 | 2.8 | 110.2 | 3.6 | 108.4 | 3.3 |
| Hs\|NM_033360.2\|5299 | 5299 | 4594 | 1 | 58.7 | 3.4 | 64.4 | 3.3 | 148.0 | 7.0 | 131.7 | 9.8 |

TABLE 9-continued

KRAS Inhibitory Efficacy of Table 8 DsiRNAs Assayed at 1 nM in Human HeLa and Mouse Hepa 1-6 Cells

| | | | | Human - HeLa Normalized HPRT/SFRS9; vs NC1, NC5, NC7 | | | | Mouse - Hepa 1-6 Normalized HPRT/Rpl23; vs NC1, NC5, NC7 | | | |
| | | | | Assay: Hs KRAS 268-385 (MAX) | | Assay: Hs KRAS 3393-3516 (FAM) | | Assay: Mm KRAS 279-390 (MAX) | | Assay: Mm KRAS 1064-1161 (FAM) | |
| Name | Hs Loc | Mm Loc | nM | % Left Ave | % Error | % Left Ave | % Error | % Left Ave | % Error | % Left Ave | % Error |
|---|---|---|---|---|---|---|---|---|---|---|---|
| Hs\|NM_033360.2\|5300 | 5300 | 4597 | 1 | 87.6 | 9.8 | 93.5 | 6.4 | 127.6 | 11.6 | 136.8 | 10.6 |
| Hs\|NM_033360.2\|5304 | 5304 | 4495 | 1 | 116.3 | 7.7 | 91.4 | 8.9 | 91.2 | 2.0 | 107.3 | 2.7 |
| Hs\|NM_033360.2\|5305 | 5305 | 4498 | 1 | 107.0 | 6.1 | 109.6 | 6.2 | 117.0 | 5.4 | 126.7 | 4.5 |
| Hs\|NM_033360.2\|5306 | 5306 | 4543 | 1 | 97.6 | 1.4 | 110.9 | 1.7 | 99.0 | 8.4 | 95.3 | 7.2 |
| Hs\|NM_033360.2\|5307 | 5307 | 4549 | 1 | 98.3 | 5.2 | 113.5 | 1.6 | 116.9 | 2.1 | 112.7 | 1.8 |
| Hs\|NM_033360.2\|5308 | 5308 | 4552 | 1 | 147.8 | 11.0 | 180.2 | 11.4 | 143.6 | 10.3 | 124.2 | 7.3 |
| Hs\|NM_033360.2\|5309 | 5309 | 4592 | 1 | 129.4 | 8.9 | 152.9 | 11.7 | 118.2 | 5.2 | 115.1 | 6.7 |
| Hs\|NM_033360.2\|5347 | 5347 | 4595 | 1 | 41.5 | 2.4 | 45.4 | 3.9 | 105.0 | 9.6 | 90.0 | 7.1 |
| Hs\|NM_033360.2\|5348 | 5348 | 4632 | 1 | 75.8 | 8.9 | 88.4 | 6.6 | 119.6 | 8.6 | 105.3 | 12.9 |
| Hs\|NM_033360.2\|5349 | 5349 | 4496 | 1 | 78.2 | 2.7 | 65.1 | 3.0 | 95.2 | 3.2 | 111.7 | 1.9 |
| Hs\|NM_033360.2\|5350 | 5350 | 4499 | 1 | 92.3 | 2.7 | 94.9 | 2.5 | 114.7 | 3.0 | 125.1 | 2.7 |
| Hs\|NM_033360.2\|5351 | 5351 | 4547 | 1 | 61.8 | 13.7 | 67.0 | 16.6 | 96.1 | 5.2 | 81.8 | 9.0 |
| Hs\|NM_033360.2\|5352 | 5352 | 4550 | 1 | 54.8 | 11.2 | 58.5 | 6.0 | 97.8 | 6.1 | 93.4 | 6.1 |
| Hs\|NM_033360.2\|5353 | 5353 | 4590 | 1 | 75.5 | 8.8 | 89.7 | 9.5 | 124.5 | 9.8 | 108.1 | 8.3 |
| Hs\|NM_033360.2\|5354 | 5354 | 4593 | 1 | 52.7 | 16.3 | 63.2 | 16.3 | 90.4 | 4.4 | 85.8 | 6.9 |
| Hs\|NM_033360.2\|5389 | 5389 | 4596 | 1 | 44.4 | 3.1 | 52.5 | 4.7 | 110.6 | 5.2 | 98.3 | 2.7 |
| Hs\|NM_033360.2\|5390 | 5390 | 4633 | 1 | 36.7 | 5.0 | 36.1 | 6.3 | 97.8 | 2.4 | 90.8 | 2.8 |
| Hs\|NM_033360.2\|5391 | 5391 | 4634 | 1 | 29.0 | 5.7 | 26.4 | 5.9 | 62.7 | 3.5 | 67.1 | 5.6 |
| Hs\|NM_033360.2\|5392 | 5392 | 4635 | 1 | 45.8 | 5.2 | 44.9 | 4.5 | 98.7 | 6.7 | 95.3 | 8.4 |
| Hs\|NM_033360.2\|5393 | 5393 | 4636 | 1 | 51.3 | 3.6 | 52.7 | 4.1 | 110.4 | 2.3 | 101.9 | 1.9 |

As shown in Table 9, 103 of 243 asymmetric DsiRNAs examined showed greater than 70% reduction of human KRAS levels in HeLa cells at 1 nM, in both qPCR assays used to determine human KRAS levels. Of these 103 DsiRNAs, 37 exhibited greater than 80% reduction of human KRAS levels in HeLa cells at 1 nM in both qPCR assays used to determine human KRAS levels. A number of asymmetric DsiRNAs also capable of inhibiting mouse KRAS levels in mouse Hepa 1-6 cells at 1 nM in the environment of a cell were also identified in such assays.

120 asymmetric DsiRNAs of the above experiment were then examined in a secondary assay ("Phase 2"), with results of such assays presented in histogram form in FIGS. 12-31. Specifically, the 120 asymmetric DsiRNAs selected from the 243 tested above were assessed for inhibition of human KRAS at 1 nM, 0.1 nM and 0.1 nM (0.1 nM was performed in duplicate, independent assays for each KRAS-targeting asymmetric DsiRNA) in the environment of human HeLa cells (FIGS. 12-21). These 120 asymmetric DsiRNAs were also assessed for inhibition of mouse KRAS at 1 nM, 0.1 nM and 0.1 nM (again, 0.1 nM was performed in duplicate, independent assays for each KRAS-targeting asymmetric DsiRNA) in the environment of mouse Hepa 1-6 cells (FIGS. 22-31). As shown in FIGS. 12-21, a remarkable number of asymmetric DsiRNAs reproducibly exhibited robust human KRAS inhibitory efficacies at 100 pM when assayed in the environment of HeLa cells. In addition, as shown in FIGS. 22-31, a number of these asymmetric DsiRNAs also showed robust mouse KRAS inhibitory efficacies at 1 nM and 100 pM when assayed in the environment of mouse Hepa 1-6 cells. (Meanwhile, human KRAS-specific inhibitory asymmetric DsiRNAs were also identified.)

Example 7

Inhibition of KRAS by Additional Preferred DsiRNAs

The remaining DsiRNA molecules shown in Tables 4-5 possessing sense and antisense strand sequences as shown and targeting KRAS wild-type sequences (and variant sequences where applicable) are designed and synthesized as described above and tested in HeLa cells (and, optionally, in mouse Hepa 1-6 cells) for inhibitory efficacy as described in Examples 3 and 6 above. The ability of these DsiRNA agents to inhibit KRAS expression is optionally assessed in comparison to corresponding KRAS target sequence-directed 21mer siRNAs (21mer siRNA identification methods identical to those used to populate the siRNA sequences of Table 2 can be applied to the DsiRNAs of Tables 4-6). The remaining selected DsiRNA agents of Tables 4-6 are expected to show efficacy as KRAS inhibitors, with a significant number of tested DsiRNA agents anticipated to exhibit greater than 50% reduction of the KRAS target at 1 nM and at 100 pM. As seen for the DsiRNA agents of Tables 2-3, a significant majority of DsiRNAs are anticipated to outperform cognate siRNA pairs, as determined via measurement of efficacy in decreasing levels of KRAS target relative to the cognate siRNA agent. The duration of such inhibitory effects is also examined at both 24 hours and 48 hours post-administration, with concentrations of 0.1 nM, 1 nM and 5 nM tested. As above, a significant majority of DsiRNAs is anticipated to outperform its cognate siRNA pair, as determined via measurement of potency and duration of effect.

Example 8

Indications

The present body of knowledge in KRAS research indicates the need for methods to assay KRAS activity and for compounds that can regulate KRAS expression for research, diagnostic, and therapeutic use. As described herein, the nucleic acid molecules of the present invention can be used in assays to diagnose disease state related to KRAS levels. In addition, the nucleic acid molecules can be used to treat disease state related to KRAS misregulation, levels, etc.

Particular disorders and disease states that can be associated with KRAS expression modulation include, but are not limited to cancer and/or proliferative diseases, conditions, or disorders and other diseases, conditions or disorders that are related to or will respond to the levels of KRAS in a cell or tissue, alone or in combination with other therapies. Particular degenerative and disease states that are associated with KRAS expression modulation include but are not limited to, for example lung cancer, colorectal cancer, bladder cancer, pancreatic cancer, breast cancer, and prostate cancer.

Gemcytabine and cyclophosphamide are non-limiting examples of chemotherapeutic agents that can be combined with or used in conjunction with the nucleic acid molecules (e.g. DsiRNA molecules) of the instant invention. Those skilled in the art will recognize that other drugs such as anti-cancer compounds and therapies can be similarly be readily combined with the nucleic acid molecules of the instant invention (e.g. DsiRNA molecules) and are hence within the scope of the instant invention. Such compounds and therapies are well known in the art (see for example Cancer: Principles and Practice of Oncology, Volumes 1 and 2, eds Devita, V. T., Hellman, S., and Rosenberg, S. A., J. B. Lippincott Company, Philadelphia, USA) and include, without limitations, antifolates; fluoropyrimidines; cytarabine; purine analogs; adenosine analogs; amsacrine; topoisomerase I inhibitors; anthrapyrazoles; retinoids; antibiotics such as bleomycin, anthacyclins, mitomycin C, dactinomycin, and mithramycin; hexamethylmelamine; dacarbazine; 1-asperginase; platinum analogs; alkylating agents such as nitrogen mustard, melphalan, chlorambucil, busulfan, ifosfamide, 4-hydroperoxycyclophosphamide, nitrosoureas, thiotepa; plant derived compounds such as vinca alkaloids, epipodophyllotoxins, taxol; Tamoxifen; radiation therapy; surgery; nutritional supplements; gene therapy; radiotherapy such as 3D-CRT; immunotoxin therapy such as ricin, monoclonal antibodies Herceptin; and the like. For combination therapy, the nucleic acids of the invention are prepared in one of two ways. First, the agents are physically combined in a preparation of nucleic acid and chemotherapeutic agent, such as a mixture of a nucleic acid of the invention encapsulated in liposomes and ifosfamide in a solution for intravenous administration, wherein both agents are present in a therapeutically effective concentration (e.g., ifosfamide in solution to deliver 1000-1250 mg/m2/day and liposome-associated nucleic acid of the invention in the same solution to deliver 0.1-100 mg/kg/day). Alternatively, the agents are administered separately but simultaneously in their respective effective doses (e.g., 1000-1250 mg/m2/d ifosfamide and 0.1 to 100 mg/kg/day nucleic acid of the invention).

Those skilled in the art will recognize that other compounds and therapies used to treat the diseases and conditions described herein can similarly be combined with the nucleic acid molecules of the instant invention (e.g. siNA molecules) and are hence within the scope of the instant invention.

Example 9

Serum Stability for DsiRNAs

Serum stability of DsiRNA agents is assessed via incubation of DsiRNA agents in 50% fetal bovine serum for various periods of time (up to 24 h) at 37° C. Serum is extracted and the nucleic acids are separated on a 20% non-denaturing PAGE and visualized with Gelstar stain. Relative levels of protection from nuclease degradation are assessed for DsiRNAs (optionally with and without modifications).

Example 10

Use of Additional Cell Culture Models to Evaluate the Down-Regulation of KRAS Gene Expression A variety of endpoints have been used in cell culture models to look at Ras-mediated effects after treatment with anti-Ras agents. Phenotypic endpoints include inhibition of cell proliferation, RNA expression, and reduction of Ras protein expression. Because KRAS oncogene mutations are directly associated with increased proliferation of certain tumor cells, a proliferation endpoint for cell culture assays is preferably used as the primary screen. There are several methods by which this endpoint can be measured. Following treatment of cells with DsiRNA, cells are allowed to grow (typically 5 days), after which the cell viability, the incorporation of [$^3$H] thymidine into cellular DNA and/or the cell density are measured. The assay of cell density can be done in a 96-well format using commercially available fluorescent nucleic acid stains (such as Syto® 13 or CyQuant®). As a secondary, confirmatory endpoint, a DsiRNA-mediated decrease in the level of KRas protein expression can be evaluated using a KRas-specific ELISA.

Example 11

Evaluation of Anti-KRAS DsiRNA Efficacy in a Mouse Model of KRAS Misregulation

Anti-KRAS DsiRNA chosen from in vitro assays can be further tested in mouse models, including, e.g., xenograft and other animal models as recited above. In one example, mice possessing misregulated (e.g., elevated) KRAS levels are administered a DsiRNA agent of the present invention via hydrodynamic tail vein injection. 3-4 mice per group (divided based upon specific DsiRNA agent tested) are injected with 50 μg or 200 μg of DsiRNA. Levels of KRAS RNA are evaluated using RT-qPCR. Additionally or alternatively, levels of KRas (e.g., KRas protein levels and/or cancer cell/tumor formation, growth or spread) can be evaluated using an art-recognized method, or phenotypes associated with misregulation of KRAS (e.g., tumor formation, growth, metastasis, etc.) are monitored (optionally as a proxy for measurement of KRAS transcript or KRas protein levels). Active DsiRNA in such animal models can also be subsequently tested in combination with standard chemotherapies.

Example 12

Diagnostic Uses

The DsiRNA molecules of the invention can be used in a variety of diagnostic applications, such as in the identification of molecular targets (e.g., RNA) in a variety of applications, for example, in clinical, industrial, environmental, agricultural and/or research settings. Such diagnostic use of DsiRNA molecules involves utilizing reconstituted RNAi systems, for example, using cellular lysates or partially purified cellular lysates. DsiRNA molecules of this invention can be used as diagnostic tools to examine genetic drift and mutations within diseased cells. The close relationship between DsiRNA activity and the structure of the target KRAS RNA allows the detection of mutations in a region of the KRAS molecule, which alters the base-pairing and three-dimensional structure of the target KRAS RNA. By using multiple DsiRNA molecules described in this invention, one can map nucleotide changes, which are important to RNA structure and function in vitro, as well as in cells and tissues. Cleavage of target KRAS RNAs with DsiRNA molecules can be used to inhibit gene expression and define the role of specified gene products in the progression of a KRAS-associated disease or disorder. In this manner, other genetic targets can be defined as important mediators of the disease. These experiments will lead to better treatment of the disease progression by affording the possibility of combination therapies (e.g., multiple DsiRNA molecules targeted to different genes, DsiRNA molecules coupled with known small molecule inhibitors, or intermittent treatment with combinations of DsiRNA molecules and/or other chemical or biological molecules). Other in vitro uses of DsiRNA molecules of this invention are well known in the art, and include detection of the presence of RNAs associated with a disease or related condition. Such RNA is detected by determining the presence of a cleavage product after treatment with a DsiRNA using standard methodologies, for example, fluorescence resonance emission transfer (FRET).

In a specific example, DsiRNA molecules that cleave only wild-type or mutant or polymorphic forms of the target KRAS RNA are used for the assay. The first DsiRNA molecules (i.e., those that cleave only wild-type forms of target KRAS RNA) are used to identify wild-type KRAS RNA present in the sample and the second DsiRNA molecules (i.e., those that cleave only mutant or polymorphic forms of target RNA) are used to identify mutant or polymorphic KRAS RNA in the sample. As reaction controls, synthetic substrates of both wild-type and mutant or polymorphic KRAS RNA are cleaved by both DsiRNA molecules to demonstrate the relative DsiRNA efficiencies in the reactions and the absence of cleavage of the "non-targeted" KRAS RNA species. The cleavage products from the synthetic substrates also serve to generate size markers for the analysis of wild-type and mutant KRAS RNAs in the sample population. Thus, each analysis requires two DsiRNA molecules, two substrates and one unknown sample, which is combined into six reactions. The presence of cleavage products is determined using an RNase protection assay so that full-length and cleavage fragments of each KRAS RNA can be analyzed in one lane of a polyacrylamide gel. It is not absolutely required to quantify the results to gain insight into the expression of mutant or polymorphic KRAS RNAs and putative risk of KRAS-associated phenotypic changes in target cells. The expression of KRAS mRNA whose protein product is implicated in the development of the phenotype (i.e., disease related/associated) is adequate to establish risk. If probes of comparable specific activity are used for both transcripts, then a qualitative comparison of KRAS RNA levels is adequate and decreases the cost of the initial diagnosis. Higher mutant or polymorphic form to wild-type ratios are correlated with higher risk whether KRAS RNA levels are compared qualitatively or quantitatively.

All patents and publications mentioned in the specification are indicative of the levels of skill of those skilled in the art to which the invention pertains. All references cited in this disclosure are incorporated by reference to the same extent as if each reference had been incorporated by reference in its entirety individually.

One skilled in the art would readily appreciate that the present invention is well adapted to carry out the objects and obtain the ends and advantages mentioned, as well as those inherent therein. The methods and compositions described herein as presently representative of preferred embodiments are exemplary and are not intended as limitations on the scope of the invention. Changes therein and other uses will occur to those skilled in the art, which are encompassed within the spirit of the invention, are defined by the scope of the claims.

It will be readily apparent to one skilled in the art that varying substitutions and modifications can be made to the invention disclosed herein without departing from the scope and spirit of the invention. Thus, such additional embodiments are within the scope of the present invention and the following claims. The present invention teaches one skilled in the art to test various combinations and/or substitutions of chemical modifications described herein toward generating nucleic acid constructs with improved activity for mediating RNAi activity. Such improved activity can comprise improved stability, improved bioavailability, and/or improved activation of cellular responses mediating RNAi. Therefore, the specific embodiments described herein are not limiting and one skilled in the art can readily appreciate that specific combinations of the modifications described herein can be tested without undue experimentation toward identifying DsiRNA molecules with improved RNAi activity.

The invention illustratively described herein suitably can be practiced in the absence of any element or elements, limitation or limitations that are not specifically disclosed herein. Thus, for example, in each instance herein any of the terms "comprising", "consisting essentially of", and "consisting of" may be replaced with either of the other two terms. The terms and expressions which have been employed are used as terms of description and not of limitation, and there is no intention that in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments, optional features, modification and variation of the concepts herein disclosed may be resorted to by those skilled in the art, and that such modifications and variations are considered to be within the scope of this invention as defined by the description and the appended claims.

In addition, where features or aspects of the invention are described in terms of Markush groups or other grouping of alternatives, those skilled in the art will recognize that the invention is also thereby described in terms of any individual member or subgroup of members of the Markush group or other group.

The use of the terms "a" and "an" and "the" and similar referents in the context of describing the invention (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

Embodiments of this invention are described herein, including the best mode known to the inventors for carrying out the invention. Variations of those embodiments may become apparent to those of ordinary skill in the art upon reading the foregoing description.

The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context. Those skilled in the art will recognize, or be able to ascertain using no more than routine experimentation, many equivalents to the specific embodiments of the invention described herein. Such equivalents are intended to be encompassed by the following claims.

LENGTHY TABLES

The patent contains a lengthy table section. A copy of the table is available in electronic form from the USPTO web site (http://seqdata.uspto.gov/?pageRequest=docDetail&DocID=US08372816B2). An electronic copy of the table will also be available from the USPTO upon request and payment of the fee set forth in 37 CFR 1.19(b)(3).

SEQUENCE LISTING (8550 sequences)

SEQ ID NO: 1 - DNA, 5436 bp, Homo sapiens
ggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagagagtggaggatgctttttatacattggtgagggagatccgacaatacagattgaaaaaaatcagcaaagaagaaaagactcctggctgtgtgaaaattaaaaaatgcattataatgtaatctgggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggtttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccgcacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgacaaaaaaaaaaaaaaa

SEQ ID NO: 2 - protein, 189 aa, Homo sapiens [sequence omitted]

SEQ ID NO: 3 - DNA, 5312 bp, Homo sapiens
ggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggtttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccgcacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgacaaaaaaaaaaaaaaa

SEQ ID NO: 4 - protein, 188 aa, Homo sapiens [sequence omitted]

SEQ ID NO: 5 - RNA, 25 nt, Homo sapiens
caggucaagaggaguacagugcaau

SEQ ID NO: 6 - RNA, 27 nt, Homo sapiens
agcaggucaagaggaguacagugcaau

SEQ ID NO: 7 - RNA, 27 nt, Homo sapiens
agcaggucaagaggaguacagugcaua

SEQ ID NO: 8 - DNA, 25 bp, Artificial Sequence
  Description of Artificial Sequence: Synthetic oligonucleotide
  Description of Combined DNA/RNA Molecule: Synthetic oligonucleotide
uuagcauuuguuuuagcauuaccta

SEQ ID NO: 9 - RNA, 27 nt, Artificial Sequence
  Description of Artificial Sequence: Synthetic oligonucleotide
uauuagcauuuguuuuagcauuaccua

SEQ ID NO: 10 - RNA, 27 nt, Artificial Sequence
  Description of Artificial Sequence: Synthetic oligonucleotide
uauuagcauuuguuuuagcauuacccc

SEQ ID NO: 11 - RNA, 27 nt, Artificial Sequence
  Description of Artificial Sequence: Synthetic oligonucleotide
ucuugccuacgccaccagcuccaacua

SEQ ID NO: 12 - RNA, 27 nt, Artificial Sequence
  Description of Artificial Sequence: Synthetic oligonucleotide
cucuugaccugcugugucgagaauauc

SEQ ID NO: 13 - RNA, 27 nt, Artificial Sequence
  Description of Artificial Sequence: Synthetic oligonucleotide
uccucuugaccugcugugucgagaaua

SEQ ID NO: 14 - RNA, 27 nt, Artificial Sequence
  Description of Artificial Sequence: Synthetic oligonucleotide
auugcacuguacuccucuugaccugcu

SEQ ID NO: 15 - RNA, 27 nt, Artificial Sequence
  Description of Artificial Sequence: Synthetic oligonucleotide
ucccucauugcacuguacuccucuuga

SEQ ID NO: 16 - RNA, 27 nt, Artificial Sequence
  Description of Artificial Sequence: Synthetic oligonucleotide
cauguacuggucccucauugcacugua

SEQ ID NO: 17 - RNA, 27 nt, Artificial Sequence
  Description of Artificial Sequence: Synthetic oligonucleotide
aaauacacaaagaaagcccuccccagu

SEQ ID NO: 18 - RNA, 27 nt, Artificial Sequence
  Description of Artificial Sequence: Synthetic oligonucleotide
ggcaaauacacaaagaaagcccucccc

SEQ ID NO: 19 - RNA, 27 nt, Artificial Sequence
  Description of Artificial Sequence: Synthetic oligonucleotide
auggcaaauacacaaagaaagcccucc

SEQ ID NO: 20 - RNA, 27 nt, Artificial Sequence
  Description of Artificial Sequence: Synthetic oligonucleotide
auuuauggcaaauacacaaagaaagcc

SEQ ID NO: 21 - RNA, 27 nt, Artificial Sequence
  Description of Artificial Sequence: Synthetic oligonucleotide
guauuauuuauggcaaauacacaaaga

SEQ ID NO: 22 - RNA, 27 nt, Artificial Sequence
  Description of Artificial Sequence: Synthetic oligonucleotide
aguauuauuuauggcaaauacacaaag

SEQ ID NO: 23 - RNA, 27 nt, Artificial Sequence
  Description of Artificial Sequence: Synthetic oligonucleotide
uaguauuauuuauggcaaauacacaaa

SEQ ID NO: 24 - RNA, 27 nt, Artificial Sequence
  Description of Artificial Sequence: Synthetic oligonucleotide
uuaguauuauuuauggcaaauacacaa

SEQ ID NO: 25 - RNA, 27 nt, Artificial Sequence
  Description of Artificial Sequence: Synthetic oligonucleotide
uuuaguauuauuuauggcaaauacaca

SEQ ID NO: 26 - RNA, 27 nt, Artificial Sequence
  Description of Artificial Sequence: Synthetic oligonucleotide
auuuaguauuauuuauggcaaauacac

SEQ ID NO: 27 - RNA, 27 nt, Artificial Sequence
  Description of Artificial Sequence: Synthetic oligonucleotide
cuucaaaugauuuaguauuauuuaugg

SEQ ID NO: 28 - RNA, 27 nt, Artificial Sequence
  Description of Artificial Sequence: Synthetic oligonucleotide
aauaucuucaaaugauuuaguauuauu

SEQ ID NO: 29 - RNA, 27 nt, Artificial Sequence
  Description of Artificial Sequence: Synthetic oligonucleotide
ggugaauaucuucaaaugauuuaguau

SEQ ID NO: 30 - RNA, 27 nt, Artificial Sequence
  Description of Artificial Sequence: Synthetic oligonucleotide
auggugaauaucuucaaaugauuuagu

SEQ ID NO: 31 - RNA, 27 nt, Artificial Sequence
  Description of Artificial Sequence: Synthetic oligonucleotide
cuauaauggugaauaucuucaaaugau

SEQ ID NO: 32 - RNA, 27 nt, Artificial Sequence
  Description of Artificial Sequence: Synthetic oligonucleotide
guucucuauaauggugaauaucuucaa

SEQ ID NO: 33 - RNA, 27 nt, Artificial Sequence
  Description of Artificial Sequence: Synthetic oligonucleotide
uuguucucuauaauggugaauaucuuc

SEQ ID NO: 34 - RNA, 27 nt, Artificial Sequence
  Description of Artificial Sequence: Synthetic oligonucleotide
cauuuauuuccuacuaggaccauaggu

SEQ ID NO: 35 - RNA, 27 nt, Artificial Sequence
  Description of Artificial Sequence: Synthetic oligonucleotide
ugucuacuguucuagaaggcaaaucac

SEQ ID NO: 36 - RNA, 27 nt, Artificial Sequence
  Description of Artificial Sequence: Synthetic oligonucleotide
gaacuaauguauagaaggcaucaucaa

SEQ ID NO: 37 - RNA, 27 nt, Artificial Sequence
  Description of Artificial Sequence: Synthetic oligonucleotide
uguuuucgaauuucucgaacuaaugua

SEQ ID NO: 38 - RNA, 27 nt, Artificial Sequence
  Description of Artificial Sequence: Synthetic oligonucleotide
cuuuucuuuauguuuucgaauuucucg

SEQ ID NO: 39 - RNA, 27 nt, Artificial Sequence
  Description of Artificial Sequence: Synthetic oligonucleotide
uuugcucaucuuuucuuuauguuuucg

SEQ ID NO: 40 - RNA, 27 nt, Artificial Sequence
  Description of Artificial Sequence: Synthetic oligonucleotide
ccaucuuugcucaucuuuucuuuaugu

SEQ ID NO: 41 - RNA, 27 nt, Artificial Sequence
  Description of Artificial Sequence: Synthetic oligonucleotide
gcuaauaauuuaguguaauguacaaaa

SEQ ID NO: 42 - RNA, 27 nt, Artificial Sequence
  Description of Artificial Sequence: Synthetic oligonucleotide
aaugcuaaaacaaaugcuaauaauuua

SEQ ID NO: 43 - RNA, 27 nt, Artificial Sequence
  Description of Artificial Sequence: Synthetic oligonucleotide
uagguaaugcuaaaacaaaugcuaaua

SEQ ID NO: 44 - RNA, 27 nt, Artificial Sequence
  Description of Artificial Sequence: Synthetic oligonucleotide
cuggcacuuagaggaaaaaaaaacuuc

SEQ ID NO: 45 - RNA, 27 nt, Artificial Sequence
  Description of Artificial Sequence: Synthetic oligonucleotide
caaaacucugggaauacuggcacuuag

SEQ ID NO: 46 - RNA, 27 nt, Artificial Sequence
  Description of Artificial Sequence: Synthetic oligonucleotide
aagcuucauuaauuuguuucacaccaa

SEQ ID NO: 47 - RNA, 27 nt, Artificial Sequence
  Description of Artificial Sequence: Synthetic oligonucleotide
gucucaacugaaauuaguaauuaaucc

SEQ ID NO: 48 - RNA, 27 nt, Artificial Sequence
  Description of Artificial Sequence: Synthetic oligonucleotide
aaaaauuuaguagcauguaaauauagc

SEQ ID NO: 49 - RNA, 27 nt, Artificial Sequence
  Description of Artificial Sequence: Synthetic oligonucleotide
uuuacacuauacaaaaauaguuaaaau

SEQ ID NO: 50 - RNA, 27 nt, Artificial Sequence
  Description of Artificial Sequence: Synthetic oligonucleotide
gauggaaaacaacuggaucacacugca

SEQ ID NO: 51 - DNA, 21 bp, Artificial Sequence
  Description of Artificial Sequence: Synthetic oligonucleotide
  Description of Combined DNA/RNA Molecule: Synthetic oligonucleotide
cuacgccaccagcuccaactt

SEQ ID NO: 52 - DNA, 21 bp, Artificial Sequence
  Description of Artificial Sequence: Synthetic oligonucleotide
  Description of Combined DNA/RNA Molecule: Synthetic oligonucleotide
accugcugugucgagaauatt

SEQ ID NO: 53 - DNA, 21 bp, Artificial Sequence
  Description of Artificial Sequence: Synthetic oligonucleotide
  Description of Combined DNA/RNA Molecule: Synthetic oligonucleotide
ugaccugcugugucgagaatt

SEQ ID NO: 54 - DNA, 21 bp, Artificial Sequence
  Description of Artificial Sequence: Synthetic oligonucleotide
  Description of Combined DNA/RNA Molecule: Synthetic oligonucleotide
cuguacuccucuugaccugtt

SEQ ID NO: 55 - DNA, 21 bp, Artificial Sequence
  Description of Artificial Sequence: Synthetic oligonucleotide
  Description of Combined DNA/RNA Molecule: Synthetic oligonucleotide
auugcacuguacuccucuutt

SEQ ID NO: 56 - DNA, 21 bp, Artificial Sequence
  Description of Artificial Sequence: Synthetic oligonucleotide
  Description of Combined DNA/RNA Molecule: Synthetic oligonucleotide
cuggucccucauugcacugtt

SEQ ID NO: 57 - DNA, 21 bp, Artificial Sequence
  Description of Artificial Sequence: Synthetic oligonucleotide
  Description of Combined DNA/RNA Molecule: Synthetic oligonucleotide
acaaagaaagcccuccccatt

SEQ ID NO: 58 - DNA, 21 bp, Artificial Sequence
  Description of Artificial Sequence: Synthetic oligonucleotide
  Description of Combined DNA/RNA Molecule: Synthetic oligonucleotide
aauacacaaagaaagcccutt

SEQ ID NO: 59 - DNA, 21 bp, Artificial Sequence
  Description of Artificial Sequence: Synthetic oligonucleotide
  Description of Combined DNA/RNA Molecule: Synthetic oligonucleotide
aaauacacaaagaaagccctt

SEQ ID NO: 60 - DNA, 21 bp, Artificial Sequence
  Description of Artificial Sequence: Synthetic oligonucleotide
  Description of Combined DNA/RNA Molecule: Synthetic oligonucleotide
ggcaaauacacaaagaaagtt

SEQ ID NO: 61 - DNA, 21 bp, Artificial Sequence
  Description of Artificial Sequence: Synthetic oligonucleotide
  Description of Combined DNA/RNA Molecule: Synthetic oligonucleotide
uuuauggcaaauacacaaatt

SEQ ID NO: 62 - DNA, 21 bp, Artificial Sequence
  Description of Artificial Sequence: Synthetic oligonucleotide
  Description of Combined DNA/RNA Molecule: Synthetic oligonucleotide
auuuauggcaaauacacaatt

SEQ ID NO: 63 - DNA, 21 bp, Artificial Sequence
  Description of Artificial Sequence: Synthetic oligonucleotide
  Description of Combined DNA/RNA Molecule: Synthetic oligonucleotide
uauuuauggcaaauacacatt

SEQ ID NO: 64 - DNA, 21 bp, Artificial Sequence
  Description of Artificial Sequence: Synthetic oligonucleotide
  Description of Combined DNA/RNA Molecule: Synthetic oligonucleotide
uuauuuauggcaaauacactt

SEQ ID NO: 65 - DNA, 21 bp, Artificial Sequence
  Description of Artificial Sequence: Synthetic oligonucleotide
  Description of Combined DNA/RNA Molecule: Synthetic oligonucleotide
auuauuuauggcaaauacatt

SEQ ID NO: 66 - DNA, 21 bp, Artificial Sequence
  Description of Artificial Sequence: Synthetic oligonucleotide
  Description of Combined DNA/RNA Molecule: Synthetic oligonucleotide
uauuauuuauggcaaauactt

SEQ ID NO: 67 - DNA, 21 bp, Artificial Sequence
  Description of Artificial Sequence: Synthetic oligonucleotide
  Description of Combined DNA/RNA Molecule: Synthetic oligonucleotide
augauuuaguauuauuuautt

SEQ ID NO: 68 - DNA, 21 bp, Artificial Sequence
  Description of Artificial Sequence: Synthetic oligonucleotide
  Description of Combined DNA/RNA Molecule: Synthetic oligonucleotide
uucaaaugauuuaguauuatt

SEQ ID NO: 69 - DNA, 21 bp, Artificial Sequence
  Description of Artificial Sequence: Synthetic oligonucleotide
  Description of Combined DNA/RNA Molecule: Synthetic oligonucleotide
uaucuucaaaugauuuagutt

SEQ ID NO: 70 - DNA, 21 bp, Artificial Sequence
  Description of Artificial Sequence: Synthetic oligonucleotide
  Description of Combined DNA/RNA Molecule: Synthetic oligonucleotide
aauaucuucaaaugauuuatt

SEQ ID NO: 71 - DNA, 21 bp, Artificial Sequence
  Description of Artificial Sequence: Synthetic oligonucleotide
  Description of Combined DNA/RNA Molecule: Synthetic oligonucleotide
uggugaauaucuucaaaugtt

SEQ ID NO: 72 - DNA, 21 bp, Artificial Sequence
  Description of Artificial Sequence: Synthetic oligonucleotide
  Description of Combined DNA/RNA Molecule: Synthetic oligonucleotide
uauaauggugaauaucuuctt

SEQ ID NO: 73 - DNA, 21 bp, Artificial Sequence
  Description of Artificial Sequence: Synthetic oligonucleotide
  Description of Combined DNA/RNA Molecule: Synthetic oligonucleotide
ucuauaauggugaauaucutt

SEQ ID NO: 74 - DNA, 21 bp, Artificial Sequence
  Description of Artificial Sequence: Synthetic oligonucleotide
  Description of Combined DNA/RNA Molecule: Synthetic oligonucleotide
uuuccuacuaggaccauagtt

SEQ ID NO: 75 - DNA, 21 bp, Artificial Sequence
  Description of Artificial Sequence: Synthetic oligonucleotide
  Description of Combined DNA/RNA Molecule: Synthetic oligonucleotide
cuguucuagaaggcaaauctt

SEQ ID NO: 76 - DNA, 21 bp, Artificial Sequence
  Description of Artificial Sequence: Synthetic oligonucleotide
  Description of Combined DNA/RNA Molecule: Synthetic oligonucleotide
auguauagaaggcaucauctt

SEQ ID NO: 77 - DNA, 21 bp, Artificial Sequence
  Description of Artificial Sequence: Synthetic oligonucleotide
  Description of Combined DNA/RNA Molecule: Synthetic oligonucleotide
cgaauuucucgaacuaaugtt

SEQ ID NO: 78 - DNA, 21 bp, Artificial Sequence
  Description of Artificial Sequence: Synthetic oligonucleotide
  Description of Combined DNA/RNA Molecule: Synthetic oligonucleotide
uuuauguuuucgaauuucutt

SEQ ID NO: 79 - DNA, 21 bp, Artificial Sequence
  Description of Artificial Sequence: Synthetic oligonucleotide
  Description of Combined DNA/RNA Molecule: Synthetic oligonucleotide
caucuuuucuuuauguuuutt

SEQ ID NO: 80 - DNA, 21 bp, Artificial Sequence
  Description of Artificial Sequence: Synthetic oligonucleotide
  Description of Combined DNA/RNA Molecule: Synthetic oligonucleotide
uugcucaucuuuucuuuautt

SEQ ID NO: 81 - DNA, 21 bp, Artificial Sequence
  Description of Artificial Sequence: Synthetic oligonucleotide
  Description of Combined DNA/RNA Molecule: Synthetic oligonucleotide
aauuuaguguaauguacaatt

SEQ ID NO: 82 - DNA, 21 bp, Artificial Sequence
  Description of Artificial Sequence: Synthetic oligonucleotide
  Description of Combined DNA/RNA Molecule: Synthetic oligonucleotide
aaaacaaaugcuaauaauutt

SEQ ID NO: 83 - DNA, 21 bp, Artificial Sequence
  Description of Artificial Sequence: Synthetic oligonucleotide
  Description of Combined DNA/RNA Molecule: Synthetic oligonucleotide
augcuaaaacaaaugcuaatt

SEQ ID NO: 84 - DNA, 21 bp, Artificial Sequence
  Description of Artificial Sequence: Synthetic oligonucleotide
  Description of Combined DNA/RNA Molecule: Synthetic oligonucleotide
cuuagaggaaaaaaaaacutt

SEQ ID NO: 85 - DNA, 21 bp, Artificial Sequence
  Description of Artificial Sequence: Synthetic oligonucleotide
  Description of Combined DNA/RNA Molecule: Synthetic oligonucleotide
ucugggaauacuggcacuutt

SEQ ID NO: 86 - DNA, 21 bp, Artificial Sequence
  Description of Artificial Sequence: Synthetic oligonucleotide
  Description of Combined DNA/RNA Molecule: Synthetic oligonucleotide
cauuaauuuguuucacacctt

SEQ ID NO: 87 - DNA, 21 bp, Artificial Sequence
  Description of Artificial Sequence: Synthetic oligonucleotide
  Description of Combined DNA/RNA Molecule: Synthetic oligonucleotide
acugaaauuaguaauuaautt

SEQ ID NO: 88 - DNA, 21 bp, Artificial Sequence
  Description of Artificial Sequence: Synthetic oligonucleotide
  Description of Combined DNA/RNA Molecule: Synthetic oligonucleotide
uuaguagcauguaaauauatt

SEQ ID NO: 89 - DNA, 21 bp, Artificial Sequence
  Description of Artificial Sequence: Synthetic oligonucleotide
  Description of Combined DNA/RNA Molecule: Synthetic oligonucleotide
cuauacaaaaauaguuaaatt

SEQ ID NO: 90 - DNA, 21 bp, Artificial Sequence
  Description of Artificial Sequence: Synthetic oligonucleotide
  Description of Combined DNA/RNA Molecule: Synthetic oligonucleotide
aaacaacuggaucacacugtt

SEQ ID NO: 91 - RNA, 25 nt, Artificial Sequence
  Description of Artificial Sequence: Synthetic oligonucleotide
guuggagcugguggcguaggcaaga

SEQ ID NO: 92 - RNA, 25 nt, Artificial Sequence
  Description of Artificial Sequence: Synthetic oligonucleotide
uauucucgacacagcaggucaagag

SEQ ID NO: 93 - RNA, 25 nt, Artificial Sequence
  Description of Artificial Sequence: Synthetic oligonucleotide
uucucgacacagcaggucaagagga

SEQ ID NO: 94 - RNA, 25 nt, Artificial Sequence
  Description of Artificial Sequence: Synthetic oligonucleotide
aagaggaguacagugcaaugaggga

SEQ ID NO: 95 - DNA, 25 bp, Artificial Sequence
  Description of Artificial Sequence: Synthetic oligonucleotide
  Description of Combined DNA/RNA Molecule: Synthetic oligonucleotide
cagugcaaugagggaccaguacatg

SEQ ID NO: 96 - DNA, 25 bp, Artificial Sequence
  Description of Artificial Sequence: Synthetic oligonucleotide
  Description of Combined DNA/RNA Molecule: Synthetic oligonucleotide
uggggagggcuuucuuuguguautt

SEQ ID NO: 97 - RNA, 25 nt, Artificial Sequence
  Description of Artificial Sequence: Synthetic oligonucleotide
ggagggcuuucuuuguguauuugcc

SEQ ID NO: 98 - DNA, 25 bp, Artificial Sequence
  Description of Artificial Sequence: Synthetic oligonucleotide
  Description of Combined DNA/RNA Molecule: Synthetic oligonucleotide
agggcuuucuuuguguauuugccat

SEQ ID NO: 99 - DNA, 25 bp, Artificial Sequence
  Description of Artificial Sequence: Synthetic oligonucleotide
  Description of Combined DNA/RNA Molecule: Synthetic oligonucleotide
cuuucuuuguguauuugccauaaat

SEQ ID NO: 100 - RNA, 25 nt, Artificial Sequence
  Description of Artificial Sequence: Synthetic oligonucleotide
uuuguguauuugccauaaauaauac

SEQ ID NO: 101 - DNA, 25 bp, Artificial Sequence
  Description of Artificial Sequence: Synthetic oligonucleotide
  Description of Combined DNA/RNA Molecule: Synthetic oligonucleotide
uuguguauuugccauaaauaauact

SEQ ID NO: 102 - DNA, 25 bp, Artificial Sequence
  Description of Artificial Sequence: Synthetic oligonucleotide
  Description of Combined DNA/RNA Molecule: Synthetic oligonucleotide
uguguauuugccauaaauaauacta

SEQ ID NO: 103 - RNA, 25 nt, Artificial Sequence
  Description of Artificial Sequence: Synthetic oligonucleotide
guguauuugccauaaauaauacuaa

SEQ ID NO: 104 - RNA, 25 nt, Artificial Sequence
  Description of Artificial Sequence: Synthetic oligonucleotide
uguauuugccauaaauaauacuaaa

SEQ ID NO: 105 - DNA, 25 bp, Artificial Sequence
  Description of Artificial Sequence: Synthetic oligonucleotide
  Description of Combined DNA/RNA Molecule: Synthetic oligonucleotide
guauuugccauaaauaauacuaaat

SEQ ID NO: 106 - RNA, 25 nt, Artificial Sequence
  Description of Artificial Sequence: Synthetic oligonucleotide
auaaauaauacuaaaucauuugaag

SEQ ID NO: 107 - DNA, 25 bp, Artificial Sequence
  Description of Artificial Sequence: Synthetic oligonucleotide
  Description of Combined DNA/RNA Molecule: Synthetic oligonucleotide
uaauacuaaaucauuugaagauatt

SEQ ID NO: 108 - RNA, 25 nt, Artificial Sequence
  Description of Artificial Sequence: Synthetic oligonucleotide
acuaaaucauuugaagauauucacc

SEQ ID NO: 109 - DNA, 25 bp, Artificial Sequence
  Description of Artificial Sequence: Synthetic oligonucleotide
  Description of Combined DNA/RNA Molecule: Synthetic oligonucleotide
uaaaucauuugaagauauucaccat

SEQ ID NO: 110 - RNA, 25 nt, Artificial Sequence
  Description of Artificial Sequence: Synthetic oligonucleotide
cauuugaagauauucaccauuauag

SEQ ID NO: 111 - RNA, 25 nt, Artificial Sequence
  Description of Artificial Sequence: Synthetic oligonucleotide
gaagauauucaccauuauagagaac

SEQ ID NO: 112 - RNA, 25 nt, Artificial Sequence
  Description of Artificial Sequence: Synthetic oligonucleotide
agauauucaccauuauagagaacaa

SEQ ID NO: 113 - DNA, 25 bp, Artificial Sequence
  Description of Artificial Sequence: Synthetic oligonucleotide
  Description of Combined DNA/RNA Molecule: Synthetic oligonucleotide
cuaugguccuaguaggaaauaaatg

SEQ ID NO: 114 - RNA, 25 nt, Artificial Sequence
  Description of Artificial Sequence: Synthetic oligonucleotide
gauuugccuucuagaacaguagaca

SEQ ID NO: 115 - DNA, 25 bp, Artificial Sequence
  Description of Artificial Sequence: Synthetic oligonucleotide
  Description of Combined DNA/RNA Molecule: Synthetic oligonucleotide
gaugaugccuucuauacauuagutc

SEQ ID NO: 116 - RNA, 25 nt, Artificial Sequence
  Description of Artificial Sequence: Synthetic oligonucleotide
cauuaguucgagaaauucgaaaaca

SEQ ID NO: 117 - RNA, 25 nt, Artificial Sequence
  Description of Artificial Sequence: Synthetic oligonucleotide
agaaauucgaaaacauaaagaaaag

SEQ ID NO: 118 - RNA, 25 nt, Artificial Sequence
  Description of Artificial Sequence: Synthetic oligonucleotide
aaaacauaaagaaaagaugagcaaa

SEQ ID NO: 119 - RNA, 25 nt, Artificial Sequence
  Description of Artificial Sequence: Synthetic oligonucleotide
auaaagaaaagaugagcaaagaugg

SEQ ID NO: 120 - RNA, 25 nt, Artificial Sequence
  Description of Artificial Sequence: Synthetic oligonucleotide
uuguacauuacacuaaauuauuagc

SEQ ID NO: 121 - DNA, 25 bp, Artificial Sequence
  Description of Artificial Sequence: Synthetic oligonucleotide
  Description of Combined DNA/RNA Molecule: Synthetic oligonucleotide
aauuauuagcauuuguuuuagcatt

SEQ ID NO: 122 - RNA, 25 nt, Artificial Sequence
  Description of Artificial Sequence: Synthetic oligonucleotide
aguuuuuuuuuccucuaagugccag

SEQ ID NO: 123 - DNA, 25 bp, Artificial Sequence
  Description of Artificial Sequence: Synthetic oligonucleotide
  Description of Combined DNA/RNA Molecule: Synthetic oligonucleotide
aagugccaguauucccagaguuutg

SEQ ID NO: 124 - DNA, 25 bp, Artificial Sequence
  Description of Artificial Sequence: Synthetic oligonucleotide
  Description of Combined DNA/RNA Molecule: Synthetic oligonucleotide
ggugugaaacaaauuaaugaagctt

SEQ ID NO: 125 - RNA, 25 nt, Artificial Sequence
  Description of Artificial Sequence: Synthetic oligonucleotide
auuaauuacuaauuucaguugagac

SEQ ID NO: 126 - DNA, 25 bp, Artificial Sequence
  Description of Artificial Sequence: Synthetic oligonucleotide
  Description of Combined DNA/RNA Molecule: Synthetic oligonucleotide
uauauuuacaugcuacuaaauuutt

SEQ ID NO: 127 - RNA, 25 nt, Artificial Sequence
  Description of Artificial Sequence: Synthetic oligonucleotide
uuuaacuauuuuuguauaguguaaa

SEQ ID NO: 128 - DNA, 25 bp, Artificial Sequence
  Description of Artificial Sequence: Synthetic oligonucleotide
  Description of Combined DNA/RNA Molecule: Synthetic oligonucleotide
cagugugauccaguuguuuuccatc

SEQ ID NO: 129 - RNA, 25 nt, Artificial Sequence
  Description of Artificial Sequence: Synthetic oligonucleotide
guuggagcuguuggcguaggcaaga

SEQ ID NO: 130 - RNA, 25 nt, Artificial Sequence
  Description of Artificial Sequence: Synthetic oligonucleotide
uauucucgacacagcaggucaugag

SEQ ID NO: 131 - RNA, 25 nt, Artificial Sequence
  Description of Artificial Sequence: Synthetic oligonucleotide
uucucgacacagcaggucaugagga

SEQ ID NO: 132 - DNA, 25 bp, Artificial Sequence
  Description of Artificial Sequence: Synthetic oligonucleotide
caggucaugaggaguacagugcaau

SEQ ID NO: 133 - RNA, 25 nt, Artificial Sequence
  Description of Artificial Sequence: Synthetic oligonucleotide
augaggaguacagugcaaugaggga

SEQ ID NO: 134 - RNA, 25 nt, Artificial Sequence
  Description of Artificial Sequence: Synthetic oligonucleotide
auaaagaaaagaugagcaaagacgg

SEQ ID NO: 135 - RNA, 27 nt, Artificial Sequence
  Description of Artificial Sequence: Synthetic oligonucleotide
ucuugccuacgccaacagcuccaacua

SEQ ID NO: 136 - RNA, 27 nt, Artificial Sequence
  Description of Artificial Sequence: Synthetic oligonucleotide
cucaugaccugcugugucgagaauauc

SEQ ID NO: 137 - RNA, 27 nt, Artificial Sequence
  Description of Artificial Sequence: Synthetic oligonucleotide
uccucaugaccugcugugucgagaaua

SEQ ID NO: 138 - RNA, 27 nt, Artificial Sequence
  Description of Artificial Sequence: Synthetic oligonucleotide
auugcacuguacuccucaugaccugcu

SEQ ID NO: 139 - RNA, 27 nt, Artificial Sequence
  Description of Artificial Sequence: Synthetic oligonucleotide
ucccucauugcacuguacuccucauga

SEQ ID NO: 140 - RNA, 27 nt, Artificial Sequence
  Description of Artificial Sequence: Synthetic oligonucleotide
ccgucuuugcucaucuuuucuuuaugu

SEQ ID NO: 141 - DNA, 27 bp, Homo sapiens
tagttggagctggtggcgtaggcaaga

SEQ ID NO: 142 - DNA, 27 bp, Homo sapiens
tagttggagctgttggcgtaggcaaga

SEQ ID NO: 143 - DNA, 27 bp, Homo sapiens
gatattctcgacacagcaggtcaagag

SEQ ID NO: 144 - DNA, 27 bp, Homo sapiens
gatattctcgacacagcaggtcatgag

SEQ ID NO: 145 - DNA, 27 bp, Homo sapiens
tattctcgacacagcaggtcaagagga

SEQ ID NO: 146 - DNA, 27 bp, Homo sapiens
tattctcgacacagcaggtcatgagga

SEQ ID NO: 147 - DNA, 27 bp, Homo sapiens
agcaggtcaagaggagtacagtgcaat

SEQ ID NO: 148 - DNA, 27 bp, Homo sapiens
agcaggtcatgaggagtacagtgcaat

SEQ ID NO: 149 - DNA, 27 bp, Homo sapiens
tcaagaggagtacagtgcaatgaggga

SEQ ID NO: 150 - DNA, 27 bp, Homo sapiens
tcatgaggagtacagtgcaatgaggga

SEQ ID NO: 151 - DNA, 27 bp, Homo sapiens
tacagtgcaatgagggaccagtacatg

SEQ ID NO: 152 - DNA, 27 bp, Homo sapiens
actggggagggctttctttgtgtattt

SEQ ID NO: 153 - DNA, 27 bp, Homo sapiens
ggggagggctttctttgtgtatttgcc

SEQ ID NO: 154 - DNA, 27 bp, Homo sapiens
ggagggctttctttgtgtatttgccat

SEQ ID NO: 155 - DNA, 27 bp, Homo sapiens
ggctttctttgtgtatttgccataaat

SEQ ID NO: 156 - DNA, 27 bp, Homo sapiens
tctttgtgtatttgccataaataatac

SEQ ID NO: 157 - DNA, 27 bp, Homo sapiens
ctttgtgtatttgccataaataatact

SEQ ID NO: 158 - DNA, 27 bp, Homo sapiens
tttgtgtatttgccataaataatacta

SEQ ID NO: 159 - DNA, 27 bp, Homo sapiens
ttgtgtatttgccataaataatactaa

SEQ ID NO: 160 - DNA, 27 bp, Homo sapiens
tgtgtatttgccataaataatactaaa

SEQ ID NO: 161 - DNA, 27 bp, Homo sapiens
gtgtatttgccataaataatactaaat

SEQ ID NO: 162 - DNA, 27 bp, Homo sapiens
ccataaataatactaaatcatttgaag

SEQ ID NO: 163 - DNA, 27 bp, Homo sapiens
aataatactaaatcatttgaagatatt

SEQ ID NO: 164 - DNA, 27 bp, Homo sapiens
atactaaatcatttgaagatattcacc

SEQ ID NO: 165 - DNA, 27 bp, Homo sapiens
actaaatcatttgaagatattcaccat

SEQ ID NO: 166 - DNA, 27 bp, Homo sapiens
atcatttgaagatattcaccattatag

SEQ ID NO: 167 - DNA, 27 bp, Homo sapiens
ttgaagatattcaccattatagagaac

SEQ ID NO: 168 - DNA, 27 bp, Homo sapiens
gaagatattcaccattatagagaacaa

SEQ ID NO: 169 - DNA, 27 bp, Homo sapiens
acctatggtcctagtaggaaataaatg

SEQ ID NO: 170 - DNA, 27 bp, Homo sapiens
gtgatttgccttctagaacagtagaca

SEQ ID NO: 171 - DNA, 27 bp, Homo sapiens
ttgatgatgccttctatacattagttc

SEQ ID NO: 172 - DNA, 27 bp, Homo sapiens
tacattagttcgagaaattcgaaaaca

SEQ ID NO: 173 - DNA, 27 bp, Homo sapiens
cgagaaattcgaaaacataaagaaaag

SEQ ID NO: 174 - DNA, 27 bp, Homo sapiens
cgaaaacataaagaaaagatgagcaaa

SEQ ID NO: 175 - DNA, 27 bp, Homo sapiens
acataaagaaaagatgagcaaagatgg

SEQ ID NO: 176 - DNA, 27 bp, Homo sapiens
acataaagaaaagatgagcaaagacgg

SEQ ID NO: 177 - DNA, 27 bp, Homo sapiens
ttttgtacattacactaaattattagc

SEQ ID NO: 178 - DNA, 27 bp, Homo sapiens
taaattattagcatttgttttagcatt

SEQ ID NO: 179 - DNA, 27 bp, Homo sapiens
tattagcatttgttttagcattaccta

SEQ ID NO: 180 - DNA, 27 bp, Homo sapiens
gaagtttttttttcctctaagtgccag

SEQ ID NO: 181 - DNA, 27 bp, Homo sapiens
ctaagtgccagtattcccagagttttg

SEQ ID NO: 182 - DNA, 27 bp, Homo sapiens
ttggtgtgaaacaaattaatgaagctt

SEQ ID NO: 183 - DNA, 27 bp, Homo sapiens
ggattaattactaatttcagttgagac

SEQ ID NO: 184 - DNA, 27 bp, Homo sapiens
gctatatttacatgctactaaattttt

SEQ ID NO: 185 - DNA, 27 bp, Homo sapiens
attttaactatttttgtatagtgtaaa

SEQ ID NO: 186 - DNA, 27 bp, Homo sapiens
tgcagtgtgatccagttgttttccatc

SEQ ID NO: 187 - RNA, 27 nt, Artificial Sequence
  Description of Artificial Sequence: Synthetic oligonucleotide
agcaggucaugaggaguacagugcaau

SEQ ID NO: 188 - RNA, 27 nt, Artificial Sequence
  Description of Artificial Sequence: Synthetic oligonucleotide
agcaggucaugaggaguacagugcaua

SEQ ID NO: 189 - RNA, 27 nt, Artificial Sequence
  Description of Artificial Sequence: Synthetic oligonucleotide
caaguuuauauucagucauuuucagca

SEQ ID NO: 190 - RNA, 27 nt, Artificial Sequence
  Description of Artificial Sequence: Synthetic oligonucleotide
cuaccacaaguuuauauucagucauuu

SEQ ID NO: 191 - RNA, 27 nt, Artificial Sequence
  Description of Artificial Sequence: Synthetic oligonucleotide
ccaacuaccacaaguuuauauucaguc

SEQ ID NO: 192 - RNA, 27 nt, Artificial Sequence
  Description of Artificial Sequence: Synthetic oligonucleotide
cguccacaaaaugauucugaauuagcu

SEQ ID NO: 193 - RNA, 27 nt, Artificial Sequence
  Description of Artificial Sequence: Synthetic oligonucleotide
aauccucuauuguuggaucauauucgu

SEQ ID NO: 194 - RNA, 27 nt, Artificial Sequence
  Description of Artificial Sequence: Synthetic oligonucleotide
agguuucuccaucaauuacuacuugcu

SEQ ID NO: 195 - RNA, 27 nt, Artificial Sequence
  Description of Artificial Sequence: Synthetic oligonucleotide
auggcaaauacacaaagaaagcccucc

SEQ ID NO: 196 - RNA, 27 nt, Artificial Sequence
  Description of Artificial Sequence: Synthetic oligonucleotide
guauuauuuauggcaaauacacaaaga

SEQ ID NO: 197 - RNA, 27 nt, Artificial Sequence
  Description of Artificial Sequence: Synthetic oligonucleotide
aguauuauuuauggcaaauacacaaag

SEQ ID NO: 198 - RNA, 27 nt, Artificial Sequence
  Description of Artificial Sequence: Synthetic oligonucleotide
uaguauuauuuauggcaaauacacaaa

SEQ ID NO: 199 - RNA, 27 nt, Artificial Sequence
  Description of Artificial Sequence: Synthetic oligonucleotide
uuaguauuauuuauggcaaauacacaa

SEQ ID NO: 200 - RNA, 27 nt, Artificial Sequence
  Description of Artificial Sequence: Synthetic oligonucleotide
ugauuuaguauuauuuauggcaaauac

SEQ ID NO: 201 - RNA, 27 nt, Artificial Sequence
  Description of Artificial Sequence: Synthetic oligonucleotide
augauuuaguauuauuuauggcaaaua

SEQ ID NO: 202 - RNA, 27 nt, Artificial Sequence
  Description of Artificial Sequence: Synthetic oligonucleotide
cuucaaaugauuuaguauuauuuaugg

SEQ ID NO: 203 - RNA, 27 nt, Artificial Sequence
  Description of Artificial Sequence: Synthetic oligonucleotide
ucuucaaaugauuuaguauuauuuaug

SEQ ID NO: 204 - RNA, 27 nt, Artificial Sequence
  Description of Artificial Sequence: Synthetic oligonucleotide
uaucuucaaaugauuuaguauuauuua

SEQ ID NO: 205 - RNA, 27 nt, Artificial Sequence
  Description of Artificial Sequence: Synthetic oligonucleotide
auaucuucaaaugauuuaguauuauuu

SEQ ID NO: 206 - RNA, 27 nt, Artificial Sequence
  Description of Artificial Sequence: Synthetic oligonucleotide
aauaucuucaaaugauuuaguauuauu

SEQ ID NO: 207 - RNA, 27 nt, Artificial Sequence
  Description of Artificial Sequence: Synthetic oligonucleotide
gaauaucuucaaaugauuuaguauuau

SEQ ID NO: 208 - RNA, 27 nt, Artificial Sequence
  Description of Artificial Sequence: Synthetic oligonucleotide
ucucuauaauggugaauaucuucaaau

SEQ ID NO: 209 - RNA, 27 nt, Artificial Sequence
  Description of Artificial Sequence: Synthetic oligonucleotide
guucucuauaauggugaauaucuucaa

SEQ ID NO: 210 - RNA, 27 nt, Artificial Sequence
  Description of Artificial Sequence: Synthetic oligonucleotide
uguucucuauaauggugaauaucuuca

SEQ ID NO: 211 - RNA, 27 nt, Artificial Sequence
  Description of Artificial Sequence: Synthetic oligonucleotide
uuguucucuauaauggugaauaucuuc

SEQ ID NO: 212 - RNA, 27 nt, Artificial Sequence
  Description of Artificial Sequence: Synthetic oligonucleotide
uuuguucucuauaauggugaauaucuu

SEQ ID NO: 213 - RNA, 27 nt, Artificial Sequence
  Description of Artificial Sequence: Synthetic oligonucleotide
acucuuuuaauuuguucucuauaaugg

SEQ ID NO: 214 - RNA, 27 nt, Artificial Sequence
  Description of Artificial Sequence: Synthetic oligonucleotide
uaacucuuuuaauuuguucucuauaau

SEQ ID NO: 215 - RNA, 27 nt, Artificial Sequence
  Description of Artificial Sequence: Synthetic oligonucleotide
uuaacucuuuuaauuuguucucuauaa

SEQ ID NO: 216 - RNA, 27 nt, Artificial Sequence
  Description of Artificial Sequence: Synthetic oligonucleotide
cuuaacucuuuuaauuuguucucuaua

SEQ ID NO: 217 - RNA, 27 nt, Artificial Sequence
  Description of Artificial Sequence: Synthetic oligonucleotide
ccuuaacucuuuuaauuuguucucuau

SEQ ID NO: 218 - RNA, 27 nt, Artificial Sequence
  Description of Artificial Sequence: Synthetic oligonucleotide
aggcaaaucacauuuauuuccuacuag

SEQ ID NO: 219 - RNA, 27 nt, Artificial Sequence
  Description of Artificial Sequence: Synthetic oligonucleotide
aaggcaaaucacauuuauuuccuacua

SEQ ID NO: 220 - RNA, 27 nt, Artificial Sequence
  Description of Artificial Sequence: Synthetic oligonucleotide
ucaauaaaaggaauuccauaacuucuu

SEQ ID NO: 221 - RNA, 27 nt, Artificial Sequence
  Description of Artificial Sequence: Synthetic oligonucleotide
guuucaauaaaaggaauuccauaacuu

SEQ ID NO: 222 - RNA, 27 nt, Artificial Sequence
  Description of Artificial Sequence: Synthetic oligonucleotide
uguuucaauaaaaggaauuccauaacu

SEQ ID NO: 223 - RNA, 27 nt, Artificial Sequence
  Description of Artificial Sequence: Synthetic oligonucleotide
auguuucaauaaaaggaauuccauaac

SEQ ID NO: 224 - RNA, 27 nt, Artificial Sequence
  Description of Artificial Sequence: Synthetic oligonucleotide
gauguuucaauaaaaggaauuccauaa

SEQ ID NO: 225 - RNA, 27 nt, Artificial Sequence
  Description of Artificial Sequence: Synthetic oligonucleotide
ucaccaauguauaaaaagcauccucca

SEQ ID NO: 226 - RNA, 27 nt, Artificial Sequence
  Description of Artificial Sequence: Synthetic oligonucleotide
ccucaccaauguauaaaaagcauccuc

SEQ ID NO: 227 - RNA, 27 nt, Artificial Sequence
  Description of Artificial Sequence: Synthetic oligonucleotide
cuucuuugcugauuuuuuucaaucugu

SEQ ID NO: 228 - RNA, 27 nt, Artificial Sequence
  Description of Artificial Sequence: Synthetic oligonucleotide
ucuucuuugcugauuuuuuucaaucug

SEQ ID NO: 229 - RNA, 27 nt, Artificial Sequence
  Description of Artificial Sequence: Synthetic oligonucleotide
uuucuucuuugcugauuuuuuucaauc

SEQ ID NO: 230 - RNA, 27 nt, Artificial Sequence
  Description of Artificial Sequence: Synthetic oligonucleotide
uuuucuucuuugcugauuuuuuucaau

SEQ ID NO: 231 - RNA, 27 nt, Artificial Sequence
  Description of Artificial Sequence: Synthetic oligonucleotide
cuuuucuucuuugcugauuuuuuucaa

SEQ ID NO: 232 - RNA, 27 nt, Artificial Sequence
  Description of Artificial Sequence: Synthetic oligonucleotide
ucuuuucuucuuugcugauuuuuuuca

SEQ ID NO: 233 - RNA, 27 nt, Artificial Sequence
  Description of Artificial Sequence: Synthetic oligonucleotide
cauuuuuuaauuuucacacagccagga

SEQ ID NO: 234 - RNA, 27 nt, Artificial Sequence
  Description of Artificial Sequence: Synthetic oligonucleotide
aaugcauuuuuuaauuuucacacagcc

SEQ ID NO: 235 - RNA, 27 nt, Artificial Sequence
  Description of Artificial Sequence: Synthetic oligonucleotide
uuauaaugcauuuuuuaauuuucacac

SEQ ID NO: 236 - RNA, 27 nt, Artificial Sequence
  Description of Artificial Sequence: Synthetic oligonucleotide
auuauaaugcauuuuuuaauuuucaca

SEQ ID NO: 237 - RNA, 27 nt, Artificial Sequence
  Description of Artificial Sequence: Synthetic oligonucleotide
cauuauaaugcauuuuuuaauuuucac

SEQ ID NO: 238 - RNA, 27 nt, Artificial Sequence
  Description of Artificial Sequence: Synthetic oligonucleotide
acauuauaaugcauuuuuuaauuuuca

SEQ ID NO: 239 - RNA, 27 nt, Artificial Sequence
  Description of Artificial Sequence: Synthetic oligonucleotide
uuacauuauaaugcauuuuuuaauuuu

SEQ ID NO: 240 - RNA, 27 nt, Artificial Sequence
  Description of Artificial Sequence: Synthetic oligonucleotide
auuacauuauaaugcauuuuuuaauuu

SEQ ID NO: 241 - RNA, 27 nt, Artificial Sequence
  Description of Artificial Sequence: Synthetic oligonucleotide
gauuacauuauaaugcauuuuuuaauu

SEQ ID NO: 242 - RNA, 27 nt, Artificial Sequence
  Description of Artificial Sequence: Synthetic oligonucleotide
agauuacauuauaaugcauuuuuuaau

SEQ ID NO: 243 - RNA, 27 nt, Artificial Sequence
  Description of Artificial Sequence: Synthetic oligonucleotide
ccagauuacauuauaaugcauuuuuua

SEQ ID NO: 244 - RNA, 27 nt, Artificial Sequence
  Description of Artificial Sequence: Synthetic oligonucleotide
ucaacacccagauuacauuauaaugca

SEQ ID NO: 245 - RNA, 27 nt, Artificial Sequence
  Description of Artificial Sequence: Synthetic oligonucleotide
uuucuuuauguuuucgaauuucucgaa

SEQ ID NO: 246 - RNA, 27 nt, Artificial Sequence
  Description of Artificial Sequence: Synthetic oligonucleotide
uuuucuuuauguuuucgaauuucucga

SEQ ID NO: 247 - RNA, 27 nt, Artificial Sequence
  Description of Artificial Sequence: Synthetic oligonucleotide
cuuuucuuuauguuuucgaauuucucg

SEQ ID NO: 248 - RNA, 27 nt, Artificial Sequence
  Description of Artificial Sequence: Synthetic oligonucleotide
caucuuuucuuuauguuuucgaauuuc

SEQ ID NO: 249 - RNA, 27 nt, Artificial Sequence
  Description of Artificial Sequence: Synthetic oligonucleotide
uugcucaucuuuucuuuauguuuucga

SEQ ID NO: 250 - RNA, 27 nt, Artificial Sequence
  Description of Artificial Sequence: Synthetic oligonucleotide
uuugcucaucuuuucuuuauguuuucg

SEQ ID NO: 251 - RNA, 27 nt, Artificial Sequence
  Description of Artificial Sequence: Synthetic oligonucleotide
cuucuuuuucuucuuuuuaccaucuuu

SEQ ID NO: 252 - RNA, 27 nt, Artificial Sequence
  Description of Artificial Sequence: Synthetic oligonucleotide
acuucuuuuucuucuuuuuaccaucuu

SEQ ID NO: 253 - RNA, 27 nt, Artificial Sequence
  Description of Artificial Sequence: Synthetic oligonucleotide
ugacuucuuuuucuucuuuuuaccauc

SEQ ID NO: 254 - RNA, 27 nt, Artificial Sequence
  Description of Artificial Sequence: Synthetic oligonucleotide
uugacuucuuuuucuucuuuuuaccau

SEQ ID NO: 255 - RNA, 27 nt, Artificial Sequence
  Description of Artificial Sequence: Synthetic oligonucleotide
ugucuuugacuucuuuuucuucuuuuu

SEQ ID NO: 256 - RNA, 27 nt, Artificial Sequence
  Description of Artificial Sequence: Synthetic oligonucleotide
uugucuuugacuucuuuuucuucuuuu

SEQ ID NO: 257 - RNA, 27 nt, Artificial Sequence
  Description of Artificial Sequence: Synthetic oligonucleotide
uuugucuuugacuucuuuuucuucuuu

SEQ ID NO: 258 - RNA, 27 nt, Artificial Sequence
  Description of Artificial Sequence: Synthetic oligonucleotide
uuacauaauuacacacuuugucuuuga

SEQ ID NO: 259 - RNA, 27 nt, Artificial Sequence
  Description of Artificial Sequence: Synthetic oligonucleotide
uuuacauaauuacacacuuugucuuug

SEQ ID NO: 260 - RNA, 27 nt, Artificial Sequence
  Description of Artificial Sequence: Synthetic oligonucleotide
uguauuuacauaauuacacacuuuguc

SEQ ID NO: 261 - RNA, 27 nt, Artificial Sequence
  Description of Artificial Sequence: Synthetic oligonucleotide
auuguauuuacauaauuacacacuuug

SEQ ID NO: 262 - RNA, 27 nt, Artificial Sequence
  Description of Artificial Sequence: Synthetic oligonucleotide
acaaauuguauuuacauaauuacacac

SEQ ID NO: 263 - RNA, 27 nt, Artificial Sequence
  Description of Artificial Sequence: Synthetic oligonucleotide
guacaaauuguauuuacauaauuacac

SEQ ID NO: 264 - RNA, 27 nt, Artificial Sequence
  Description of Artificial Sequence: Synthetic oligonucleotide
aaguacaaauuguauuuacauaauuac

SEQ ID NO: 265 - RNA, 27 nt, Artificial Sequence
  Description of Artificial Sequence: Synthetic oligonucleotide
aaaguacaaauuguauuuacauaauua

SEQ ID NO: 266 - RNA, 27 nt, Artificial Sequence
  Description of Artificial Sequence: Synthetic oligonucleotide
gaaaaaaguacaaauuguauuuacaua

SEQ ID NO: 267 - RNA, 27 nt, Artificial Sequence
  Description of Artificial Sequence: Synthetic oligonucleotide
agaaaaaaguacaaauuguauuuacau

SEQ ID NO: 268 - RNA, 27 nt, Artificial Sequence
  Description of Artificial Sequence: Synthetic oligonucleotide
aagaaaaaaguacaaauuguauuuaca

SEQ ID NO: 269 - RNA, 27 nt, Artificial Sequence
  Description of Artificial Sequence: Synthetic oligonucleotide
uaagaaaaaaguacaaauuguauuuac

SEQ ID NO: 270 - RNA, 27 nt, Artificial Sequence
  Description of Artificial Sequence: Synthetic oligonucleotide
augccuuaagaaaaaaguacaaauugu

SEQ ID NO: 271 - RNA, 27 nt, Artificial Sequence
  Description of Artificial Sequence: Synthetic oligonucleotide
uaugccuuaagaaaaaaguacaaauug

SEQ ID NO: 272 - RNA, 27 nt, Artificial Sequence
  Description of Artificial Sequence: Synthetic oligonucleotide
guacaaaaauuaccacuuguacuagua

SEQ ID NO: 273 - RNA, 27 nt, Artificial Sequence
  Description of Artificial Sequence: Synthetic oligonucleotide
uguacaaaaauuaccacuuguacuagu

SEQ ID NO: 274 - RNA, 27 nt, Artificial Sequence
  Description of Artificial Sequence: Synthetic oligonucleotide
guguaauguacaaaaauuaccacuugu

SEQ ID NO: 275 - RNA, 27 nt, Artificial Sequence
  Description of Artificial Sequence: Synthetic oligonucleotide
aguguaauguacaaaaauuaccacuug

SEQ ID NO: 276 - RNA, 27 nt, Artificial Sequence
  Description of Artificial Sequence: Synthetic oligonucleotide
auaauuuaguguaauguacaaaaauua

SEQ ID NO: 277 - RNA, 27 nt, Artificial Sequence
  Description of Artificial Sequence: Synthetic oligonucleotide
aauaauuuaguguaauguacaaaaauu

SEQ ID NO: 278 - RNA, 27 nt, Artificial Sequence
  Description of Artificial Sequence: Synthetic oligonucleotide
uaauaauuuaguguaauguacaaaaau

SEQ ID NO: 279 - RNA, 27 nt, Artificial Sequence
  Description of Artificial Sequence: Synthetic oligonucleotide
cuaauaauuuaguguaauguacaaaaa

SEQ ID NO: 280 - RNA, 27 nt, Artificial Sequence
  Description of Artificial Sequence: Synthetic oligonucleotide
gcuaauaauuuaguguaauguacaaaa

SEQ ID NO: 281 - RNA, 27 nt, Artificial Sequence
  Description of Artificial Sequence: Synthetic oligonucleotide
gcuaaaacaaaugcuaauaauuuagug

SEQ ID NO: 282 - RNA, 27 nt, Artificial Sequence
  Description of Artificial Sequence: Synthetic oligonucleotide
augcuaaaacaaaugcuaauaauuuag

SEQ ID NO: 283 - RNA, 27 nt, Artificial Sequence
  Description of Artificial Sequence: Synthetic oligonucleotide
aaugcuaaaacaaaugcuaauaauuua

SEQ ID NO: 284 - RNA, 27 nt, Artificial Sequence
  Description of Artificial Sequence: Synthetic oligonucleotide
uagguaaugcuaaaacaaaugcuaaua

SEQ ID NO: 285 - RNA, 27 nt, Artificial Sequence
  Description of Artificial Sequence: Synthetic oligonucleotide
aaaaauuagguaaugcuaaaacaaaug

SEQ ID NO: 286 - RNA, 27 nt, Artificial Sequence
  Description of Artificial Sequence: Synthetic oligonucleotide
aaaaaauuagguaaugcuaaaacaaau

SEQ ID NO: 287 - RNA, 27 nt, Artificial Sequence
  Description of Artificial Sequence: Synthetic oligonucleotide
gaaaaaaauuagguaaugcuaaaacaa

SEQ ID NO: 288 - RNA, 27 nt, Artificial Sequence
  Description of Artificial Sequence: Synthetic oligonucleotide
ggaaaaaaauuagguaaugcuaaaaca

SEQ ID NO: 289 - RNA, 27 nt, Artificial Sequence
  Description of Artificial Sequence: Synthetic oligonucleotide
aggaaaaaaauuagguaaugcuaaaac

SEQ ID NO: 290 - RNA, 27 nt, Artificial Sequence
  Description of Artificial Sequence: Synthetic oligonucleotide
caggaaaaaaauuagguaaugcuaaaa

SEQ ID NO: 291 - RNA, 27 nt, Artificial Sequence
  Description of Artificial Sequence: Synthetic oligonucleotide
aagcauuuaagguaaaagcuaacaguc

SEQ ID NO: 292 - RNA, 27 nt, Artificial Sequence
  Description of Artificial Sequence: Synthetic oligonucleotide
uaagcauuuaagguaaaagcuaacagu

SEQ ID NO: 293 - RNA, 27 nt, Artificial Sequence
  Description of Artificial Sequence: Synthetic oligonucleotide
uuaaaauaagcauuuaagguaaaagcu

SEQ ID NO: 294 - RNA, 27 nt, Artificial Sequence
  Description of Artificial Sequence: Synthetic oligonucleotide
uuuaaaauaagcauuuaagguaaaagc

SEQ ID NO: 295 - RNA, 27 nt, Artificial Sequence
  Description of Artificial Sequence: Synthetic oligonucleotide
uuuuaaaauaagcauuuaagguaaaag

SEQ ID NO: 296 - RNA, 27 nt, Artificial Sequence
  Description of Artificial Sequence: Synthetic oligonucleotide
cugucauuuuaaaauaagcauuuaagg

SEQ ID NO: 297 - RNA, 27 nt, Artificial Sequence
  Description of Artificial Sequence: Synthetic oligonucleotide
acugucauuuuaaaauaagcauuuaag

SEQ ID NO: 298 - RNA, 27 nt, Artificial Sequence
  Description of Artificial Sequence: Synthetic oligonucleotide
acuuccacugucauuuuaaaauaagca

SEQ ID NO: 299 - RNA, 27 nt, Artificial Sequence
  Description of Artificial Sequence: Synthetic oligonucleotide
aaacuuccacugucauuuuaaaauaag

SEQ ID NO: 300 - RNA, 27 nt, Artificial Sequence
  Description of Artificial Sequence: Synthetic oligonucleotide
gcacuuagaggaaaaaaaaacuuccac

SEQ ID NO: 301 - RNA, 27 nt, Artificial Sequence
  Description of Artificial Sequence: Synthetic oligonucleotide
uggcacuuagaggaaaaaaaaacuucc

SEQ ID NO: 302 - RNA, 27 nt, Artificial Sequence
  Description of Artificial Sequence: Synthetic oligonucleotide
cuggcacuuagaggaaaaaaaaacuuc

SEQ ID NO: 303 - RNA, 27 nt, Artificial Sequence
  Description of Artificial Sequence: Synthetic oligonucleotide
caggcauugcuaguucaaaaaccaaaa

SEQ ID NO: 304 - RNA, 27 nt, Artificial Sequence
  Description of Artificial Sequence: Synthetic oligonucleotide
uagguauucaguuucuuuuucacaggc

SEQ ID NO: 305 - RNA, 27 nt, Artificial Sequence
  Description of Artificial Sequence: Synthetic oligonucleotide
gaaaucuuagguauucaguuucuuuuu

SEQ ID NO: 306 - RNA, 27 nt, Artificial Sequence
  Description of Artificial Sequence: Synthetic oligonucleotide
agaaaucuuagguauucaguuucuuuu

SEQ ID NO: 307 - RNA, 27 nt, Artificial Sequence
  Description of Artificial Sequence: Synthetic oligonucleotide
caagacagaaaucuuagguauucaguu

SEQ ID NO: 308 - RNA, 27 nt, Artificial Sequence
  Description of Artificial Sequence: Synthetic oligonucleotide
aagaaaaauaagaaguaaucaacugca

SEQ ID NO: 309 - RNA, 27 nt, Artificial Sequence
  Description of Artificial Sequence: Synthetic oligonucleotide
uaagaaaaauaagaaguaaucaacugc

SEQ ID NO: 310 - RNA, 27 nt, Artificial Sequence
  Description of Artificial Sequence: Synthetic oligonucleotide
uugguaagaaaaauaagaaguaaucaa

SEQ ID NO: 311 - RNA, 27 nt, Artificial Sequence
  Description of Artificial Sequence: Synthetic oligonucleotide
auucacaauugguaagaaaaauaagaa

SEQ ID NO: 312 - RNA, 27 nt, Artificial Sequence
  Description of Artificial Sequence: Synthetic oligonucleotide
cauucacaauugguaagaaaaauaaga

SEQ ID NO: 313 - RNA, 27 nt, Artificial Sequence
  Description of Artificial Sequence: Synthetic oligonucleotide
acauucacaauugguaagaaaaauaag

SEQ ID NO: 314 - RNA, 27 nt, Artificial Sequence
  Description of Artificial Sequence: Synthetic oligonucleotide
cuucauuaauuuguuucacaccaacau

SEQ ID NO: 315 - RNA, 27 nt, Artificial Sequence
  Description of Artificial Sequence: Synthetic oligonucleotide
aagcuucauuaauuuguuucacaccaa

SEQ ID NO: 316 - RNA, 27 nt, Artificial Sequence
  Description of Artificial Sequence: Synthetic oligonucleotide
aaagcuucauuaauuuguuucacacca

SEQ ID NO: 317 - RNA, 27 nt, Artificial Sequence
  Description of Artificial Sequence: Synthetic oligonucleotide
augauucaaaagcuucauuaauuuguu

SEQ ID NO: 318 - RNA, 27 nt, Artificial Sequence
  Description of Artificial Sequence: Synthetic oligonucleotide
gaugauucaaaagcuucauuaauuugu

SEQ ID NO: 319 - RNA, 27 nt, Artificial Sequence
  Description of Artificial Sequence: Synthetic oligonucleotide
cauuuaugugacuagauaaaacacaga

SEQ ID NO: 320 - RNA, 27 nt, Artificial Sequence
  Description of Artificial Sequence: Synthetic oligonucleotide
ccauuuaugugacuagauaaaacacag

SEQ ID NO: 321 - RNA, 27 nt, Artificial Sequence
  Description of Artificial Sequence: Synthetic oligonucleotide
aauccauuuaugugacuagauaaaaca

SEQ ID NO: 322 - RNA, 27 nt, Artificial Sequence
  Description of Artificial Sequence: Synthetic oligonucleotide
uaauccauuuaugugacuagauaaaac

SEQ ID NO: 323 - RNA, 27 nt, Artificial Sequence
  Description of Artificial Sequence: Synthetic oligonucleotide
guaauuaauccauuuaugugacuagau

SEQ ID NO: 324 - RNA, 27 nt, Artificial Sequence
  Description of Artificial Sequence: Synthetic oligonucleotide
aguaauuaauccauuuaugugacuaga

SEQ ID NO: 325 - RNA, 27 nt, Artificial Sequence
  Description of Artificial Sequence: Synthetic oligonucleotide
cugaaauuaguaauuaauccauuuaug

SEQ ID NO: 326 - RNA, 27 nt, Artificial Sequence
  Description of Artificial Sequence: Synthetic oligonucleotide
acugaaauuaguaauuaauccauuuau

SEQ ID NO: 327 - RNA, 27 nt, Artificial Sequence
  Description of Artificial Sequence: Synthetic oligonucleotide
ucucaacugaaauuaguaauuaaucca

SEQ ID NO: 328 - RNA, 27 nt, Artificial Sequence
  Description of Artificial Sequence: Synthetic oligonucleotide
ggucucaacugaaauuaguaauuaauc

SEQ ID NO: 329 - RNA, 27 nt, Artificial Sequence
  Description of Artificial Sequence: Synthetic oligonucleotide
aggucucaacugaaauuaguaauuaau

SEQ ID NO: 330 - RNA, 27 nt, Artificial Sequence
  Description of Artificial Sequence: Synthetic oligonucleotide
aaggucucaacugaaauuaguaauuaa

SEQ ID NO: 331 - RNA, 27 nt, Artificial Sequence
  Description of Artificial Sequence: Synthetic oligonucleotide
ccucaauguuucaguaaaaaccaauua

SEQ ID NO: 332 - RNA, 27 nt, Artificial Sequence
  Description of Artificial Sequence: Synthetic oligonucleotide
guucccucaauguuucaguaaaaacca

SEQ ID NO: 333 - RNA, 27 nt, Artificial Sequence
  Description of Artificial Sequence: Synthetic oligonucleotide
uguucccucaauguuucaguaaaaacc

SEQ ID NO: 334 - RNA, 27 nt, Artificial Sequence
  Description of Artificial Sequence: Synthetic oligonucleotide
aagcccauaaauuuguguucccucaau

SEQ ID NO: 335 - RNA, 27 nt, Artificial Sequence
  Description of Artificial Sequence: Synthetic oligonucleotide
gaagcccauaaauuuguguucccucaa

SEQ ID NO: 336 - RNA, 27 nt, Artificial Sequence
  Description of Artificial Sequence: Synthetic oligonucleotide
gugaacaguguaacuuuacauucauca

SEQ ID NO: 337 - RNA, 27 nt, Artificial Sequence
  Description of Artificial Sequence: Synthetic oligonucleotide
ugugaacaguguaacuuuacauucauc

SEQ ID NO: 338 - RNA, 27 nt, Artificial Sequence
  Description of Artificial Sequence: Synthetic oligonucleotide
uuuuauagaaaaaauauaauauuuugg

SEQ ID NO: 339 - RNA, 27 nt, Artificial Sequence
  Description of Artificial Sequence: Synthetic oligonucleotide
uuuuuauagaaaaaauauaauauuuug

SEQ ID NO: 340 - RNA, 27 nt, Artificial Sequence
  Description of Artificial Sequence: Synthetic oligonucleotide
cuuuuuauagaaaaaauauaauauuuu

SEQ ID NO: 341 - RNA, 27 nt, Artificial Sequence
  Description of Artificial Sequence: Synthetic oligonucleotide
ucuuuuuauagaaaaaauauaauauuu

SEQ ID NO: 342 - RNA, 27 nt, Artificial Sequence
  Description of Artificial Sequence: Synthetic oligonucleotide
uuucuuuuuauagaaaaaauauaauau

SEQ ID NO: 343 - RNA, 27 nt, Artificial Sequence
  Description of Artificial Sequence: Synthetic oligonucleotide
uuuucuuuuuauagaaaaaauauaaua

SEQ ID NO: 344 - RNA, 27 nt, Artificial Sequence
  Description of Artificial Sequence: Synthetic oligonucleotide
uuuuucuuuuuauagaaaaaauauaau

SEQ ID NO: 345 - RNA, 27 nt, Artificial Sequence
  Description of Artificial Sequence: Synthetic oligonucleotide
uuuuuucuuuuuauagaaaaaauauaa

SEQ ID NO: 346 - RNA, 27 nt, Artificial Sequence
  Description of Artificial Sequence: Synthetic oligonucleotide
uuuuuuucuuuuuauagaaaaaauaua

SEQ ID NO: 347 - RNA, 27 nt, Artificial Sequence
  Description of Artificial Sequence: Synthetic oligonucleotide
auuuuuuucuuuuuauagaaaaaauau

SEQ ID NO: 348 - RNA, 27 nt, Artificial Sequence
  Description of Artificial Sequence: Synthetic oligonucleotide
cauuuuuuucuuuuuauagaaaaaaua

SEQ ID NO: 349 - RNA, 27 nt, Artificial Sequence
  Description of Artificial Sequence: Synthetic oligonucleotide
ccauuuuuuucuuuuuauagaaaaaau

SEQ ID NO: 350 - RNA, 27 nt, Artificial Sequence
  Description of Artificial Sequence: Synthetic oligonucleotide
uuuuuccauuuuuuucuuuuuauagaa

SEQ ID NO: 351 - RNA, 27 nt, Artificial Sequence
  Description of Artificial Sequence: Synthetic oligonucleotide
uuuuuuccauuuuuuucuuuuuauaga

SEQ ID NO: 352 - RNA, 27 nt, Artificial Sequence
  Description of Artificial Sequence: Synthetic oligonucleotide
auuuuuuuccauuuuuuucuuuuuaua

SEQ ID NO: 353 - RNA, 27 nt, Artificial Sequence
  Description of Artificial Sequence: Synthetic oligonucleotide
aauuuuuuuccauuuuuuucuuuuuau

SEQ ID NO: 354 - RNA, 27 nt, Artificial Sequence
  Description of Artificial Sequence: Synthetic oligonucleotide
uaauuuuuuuccauuuuuuucuuuuua

SEQ ID NO: 355 - RNA, 27 nt, Artificial Sequence
  Description of Artificial Sequence: Synthetic oligonucleotide
guaauuuuuuuccauuuuuuucuuuuu

SEQ ID NO: 356 - RNA, 27 nt, Artificial Sequence
  Description of Artificial Sequence: Synthetic oligonucleotide
uguaauuuuuuuccauuuuuuucuuuu

SEQ ID NO: 357 - RNA, 27 nt, Artificial Sequence
  Description of Artificial Sequence: Synthetic oligonucleotide
uuguaauuuuuuuccauuuuuuucuuu

SEQ ID NO: 358 - RNA, 27 nt, Artificial Sequence
  Description of Artificial Sequence: Synthetic oligonucleotide
cuuguaauuuuuuuccauuuuuuucuu

SEQ ID NO: 359 - RNA, 27 nt, Artificial Sequence
  Description of Artificial Sequence: Synthetic oligonucleotide
uugccuuguaauuuuuuuccauuuuuu

SEQ ID NO: 360 - RNA, 27 nt, Artificial Sequence
  Description of Artificial Sequence: Synthetic oligonucleotide
auugccuuguaauuuuuuuccauuuuu

SEQ ID NO: 361 - RNA, 27 nt, Artificial Sequence
  Description of Artificial Sequence: Synthetic oligonucleotide
uuuccauugccuuguaauuuuuuucca

SEQ ID NO: 362 - RNA, 27 nt, Artificial Sequence
  Description of Artificial Sequence: Synthetic oligonucleotide
guuuccauugccuuguaauuuuuuucc

SEQ ID NO: 363 - RNA, 27 nt, Artificial Sequence
  Description of Artificial Sequence: Synthetic oligonucleotide
aguuuccauugccuuguaauuuuuuuc

SEQ ID NO: 364 - RNA, 27 nt, Artificial Sequence
  Description of Artificial Sequence: Synthetic oligonucleotide
auuuaucuaaugugaaaaggaaauggc

SEQ ID NO: 365 - RNA, 27 nt, Artificial Sequence
  Description of Artificial Sequence: Synthetic oligonucleotide
auaguaauuuaucuaaugugaaaagga

SEQ ID NO: 366 - RNA, 27 nt, Artificial Sequence
  Description of Artificial Sequence: Synthetic oligonucleotide
agucuuuauaguaauuuaucuaaugug

SEQ ID NO: 367 - RNA, 27 nt, Artificial Sequence
  Description of Artificial Sequence: Synthetic oligonucleotide
gagucuuuauaguaauuuaucuaaugu

SEQ ID NO: 368 - RNA, 27 nt, Artificial Sequence
  Description of Artificial Sequence: Synthetic oligonucleotide
ggagucuuuauaguaauuuaucuaaug

SEQ ID NO: 369 - RNA, 27 nt, Artificial Sequence
  Description of Artificial Sequence: Synthetic oligonucleotide
uugcuauaauaauccccauuucauacu

SEQ ID NO: 370 - RNA, 27 nt, Artificial Sequence
  Description of Artificial Sequence: Synthetic oligonucleotide
ccaaaaugguugcuauaauaaucccca

SEQ ID NO: 371 - RNA, 27 nt, Artificial Sequence
  Description of Artificial Sequence: Synthetic oligonucleotide
aaaauuuaguagcauguaaauauagcc

SEQ ID NO: 372 - RNA, 27 nt, Artificial Sequence
  Description of Artificial Sequence: Synthetic oligonucleotide
aaaaauuuaguagcauguaaauauagc

SEQ ID NO: 373 - RNA, 27 nt, Artificial Sequence
  Description of Artificial Sequence: Synthetic oligonucleotide
uaaaaauuuaguagcauguaaauauag

SEQ ID NO: 374 - RNA, 27 nt, Artificial Sequence
  Description of Artificial Sequence: Synthetic oligonucleotide
auaaaaauuuaguagcauguaaauaua

SEQ ID NO: 375 - RNA, 27 nt, Artificial Sequence
  Description of Artificial Sequence: Synthetic oligonucleotide
uauaaaaauuuaguagcauguaaauau

SEQ ID NO: 376 - RNA, 27 nt, Artificial Sequence
  Description of Artificial Sequence: Synthetic oligonucleotide
auuauuauaaaaauuuaguagcaugua

SEQ ID NO: 377 - RNA, 27 nt, Artificial Sequence
  Description of Artificial Sequence: Synthetic oligonucleotide
cuuuucaauuauuauaaaaauuuagua

SEQ ID NO: 378 - RNA, 27 nt, Artificial Sequence
  Description of Artificial Sequence: Synthetic oligonucleotide
ucuuuucaauuauuauaaaaauuuagu

SEQ ID NO: 379 - RNA, 27 nt, Artificial Sequence
  Description of Artificial Sequence: Synthetic oligonucleotide
aaucuuuucaauuauuauaaaaauuua

SEQ ID NO: 380 - RNA, 27 nt, Artificial Sequence
  Description of Artificial Sequence: Synthetic oligonucleotide
aaaucuuuucaauuauuauaaaaauuu

SEQ ID NO: 381 - RNA, 27 nt, Artificial Sequence
  Description of Artificial Sequence: Synthetic oligonucleotide
aaaaucuuuucaauuauuauaaaaauu

SEQ ID NO: 382 - RNA, 27 nt, Artificial Sequence
  Description of Artificial Sequence: Synthetic oligonucleotide
uaaaaucuuuucaauuauuauaaaaau

SEQ ID NO: 383 - RNA, 27 nt, Artificial Sequence
  Description of Artificial Sequence: Synthetic oligonucleotide
uuaaaaucuuuucaauuauuauaaaaa

SEQ ID NO: 384 - RNA, 27 nt, Artificial Sequence
  Description of Artificial Sequence: Synthetic oligonucleotide
guuaaaaucuuuucaauuauuauaaaa

SEQ ID NO: 385 - RNA, 27 nt, Artificial Sequence
  Description of Artificial Sequence: Synthetic oligonucleotide
uguuaaaaucuuuucaauuauuauaaa

SEQ ID NO: 386 - RNA, 27 nt, Artificial Sequence
  Description of Artificial Sequence: Synthetic oligonucleotide
uuguuaaaaucuuuucaauuauuauaa

SEQ ID NO: 387 - RNA, 27 nt, Artificial Sequence
  Description of Artificial Sequence: Synthetic oligonucleotide
cuuguuaaaaucuuuucaauuauuaua

SEQ ID NO: 388 - RNA, 27 nt, Artificial Sequence
  Description of Artificial Sequence: Synthetic oligonucleotide
uauacuuguuaaaaucuuuucaauuau

SEQ ID NO: 389 - RNA, 27 nt, Artificial Sequence
  Description of Artificial Sequence: Synthetic oligonucleotide
uuauacuuguuaaaaucuuuucaauua

SEQ ID NO: 390 - RNA, 27 nt, Artificial Sequence
  Description of Artificial Sequence: Synthetic oligonucleotide
uuuuauacuuguuaaaaucuuuucaau

SEQ ID NO: 391 - RNA, 27 nt, Artificial Sequence
  Description of Artificial Sequence: Synthetic oligonucleotide
uuuuuauacuuguuaaaaucuuuucaa

SEQ ID NO: 392 - RNA, 27 nt, Artificial Sequence
  Description of Artificial Sequence: Synthetic oligonucleotide
uuuuuuauacuuguuaaaaucuuuuca

SEQ ID NO: 393 - RNA, 27 nt, Artificial Sequence
  Description of Artificial Sequence: Synthetic oligonucleotide
auuuuuuauacuuguuaaaaucuuuuc

SEQ ID NO: 394 - RNA, 27 nt, Artificial Sequence
  Description of Artificial Sequence: Synthetic oligonucleotide
aauuuuuuauacuuguuaaaaucuuuu

SEQ ID NO: 395 - RNA, 27 nt, Artificial Sequence
  Description of Artificial Sequence: Synthetic oligonucleotide
gaauuuuuuauacuuguuaaaaucuuu

SEQ ID NO: 396 - RNA, 27 nt, Artificial Sequence
  Description of Artificial Sequence: Synthetic oligonucleotide
agaauuuuuuauacuuguuaaaaucuu

SEQ ID NO: 397 - RNA, 27 nt, Artificial Sequence
  Description of Artificial Sequence: Synthetic oligonucleotide
gagaauuuuuuauacuuguuaaaaucu

SEQ ID NO: 398 - RNA, 27 nt, Artificial Sequence
  Description of Artificial Sequence: Synthetic oligonucleotide
ugagaauuuuuuauacuuguuaaaauc

SEQ ID NO: 399 - RNA, 27 nt, Artificial Sequence
  Description of Artificial Sequence: Synthetic oligonucleotide
auuccuaugagaauuuuuuauacuugu

SEQ ID NO: 400 - RNA, 27 nt, Artificial Sequence
  Description of Artificial Sequence: Synthetic oligonucleotide
aauuccuaugagaauuuuuuauacuug

SEQ ID NO: 401 - RNA, 27 nt, Artificial Sequence
  Description of Artificial Sequence: Synthetic oligonucleotide
uaauuccuaugagaauuuuuuauacuu

SEQ ID NO: 402 - RNA, 27 nt, Artificial Sequence
  Description of Artificial Sequence: Synthetic oligonucleotide
uuaauuccuaugagaauuuuuuauacu

SEQ ID NO: 403 - RNA, 27 nt, Artificial Sequence
  Description of Artificial Sequence: Synthetic oligonucleotide
uuuaauuccuaugagaauuuuuuauac

SEQ ID NO: 404 - RNA, 27 nt, Artificial Sequence
  Description of Artificial Sequence: Synthetic oligonucleotide
auuuaauuccuaugagaauuuuuuaua

SEQ ID NO: 405 - RNA, 27 nt, Artificial Sequence
  Description of Artificial Sequence: Synthetic oligonucleotide
cauuuaauuccuaugagaauuuuuuau

SEQ ID NO: 406 - RNA, 27 nt, Artificial Sequence
  Description of Artificial Sequence: Synthetic oligonucleotide
acauuuaauuccuaugagaauuuuuua

SEQ ID NO: 407 - RNA, 27 nt, Artificial Sequence
  Description of Artificial Sequence: Synthetic oligonucleotide
cuacauuuaauuccuaugagaauuuuu

SEQ ID NO: 408 - RNA, 27 nt, Artificial Sequence
  Description of Artificial Sequence: Synthetic oligonucleotide
acuacauuuaauuccuaugagaauuuu

SEQ ID NO: 409 - RNA, 27 nt, Artificial Sequence
  Description of Artificial Sequence: Synthetic oligonucleotide
aagauuuaaaguuauacuaugaaagag

SEQ ID NO: 410 - RNA, 27 nt, Artificial Sequence
  Description of Artificial Sequence: Synthetic oligonucleotide
aagaaaagauuuaaaguuauacuauga

SEQ ID NO: 411 - RNA, 27 nt, Artificial Sequence
  Description of Artificial Sequence: Synthetic oligonucleotide
gaagaaaagauuuaaaguuauacuaug

SEQ ID NO: 412 - RNA, 27 nt, Artificial Sequence
  Description of Artificial Sequence: Synthetic oligonucleotide
agacucaaguugaagaaaagauuuaaa

SEQ ID NO: 413 - RNA, 27 nt, Artificial Sequence
  Description of Artificial Sequence: Synthetic oligonucleotide
aagacucaaguugaagaaaagauuuaa

SEQ ID NO: 414 - RNA, 27 nt, Artificial Sequence
  Description of Artificial Sequence: Synthetic oligonucleotide
uuaaaacuaucuucaaagacucaaguu

SEQ ID NO: 415 - RNA, 27 nt, Artificial Sequence
  Description of Artificial Sequence: Synthetic oligonucleotide
aauuaaaacuaucuucaaagacucaag

SEQ ID NO: 416 - RNA, 27 nt, Artificial Sequence
  Description of Artificial Sequence: Synthetic oligonucleotide
gaauuaaaacuaucuucaaagacucaa

SEQ ID NO: 417 - RNA, 27 nt, Artificial Sequence
  Description of Artificial Sequence: Synthetic oligonucleotide
ugucacaagcagaauuaaaacuaucuu

SEQ ID NO: 418 - RNA, 27 nt, Artificial Sequence
  Description of Artificial Sequence: Synthetic oligonucleotide
augucacaagcagaauuaaaacuaucu

SEQ ID NO: 419 - RNA, 27 nt, Artificial Sequence
  Description of Artificial Sequence: Synthetic oligonucleotide
aaugucacaagcagaauuaaaacuauc

SEQ ID NO: 420 - RNA, 27 nt, Artificial Sequence
  Description of Artificial Sequence: Synthetic oligonucleotide
ccaaauaaucuuuuaaugucacaagca

SEQ ID NO: 421 - RNA, 27 nt, Artificial Sequence
  Description of Artificial Sequence: Synthetic oligonucleotide
guuuucuuaagaaacaaaagcaaugcu

SEQ ID NO: 422 - RNA, 27 nt, Artificial Sequence
  Description of Artificial Sequence: Synthetic oligonucleotide
uguuuucuuaagaaacaaaagcaaugc

SEQ ID NO: 423 - RNA, 27 nt, Artificial Sequence
  Description of Artificial Sequence: Synthetic oligonucleotide
agaguuuguuuucuuaagaaacaaaag

SEQ ID NO: 424 - RNA, 27 nt, Artificial Sequence
  Description of Artificial Sequence: Synthetic oligonucleotide
uuaaaaaagaguuuguuuucuuaagaa

SEQ ID NO: 425 - RNA, 27 nt, Artificial Sequence
  Description of Artificial Sequence: Synthetic oligonucleotide
uuuaaaaaagaguuuguuuucuuaaga

SEQ ID NO: 426 - RNA, 27 nt, Artificial Sequence
  Description of Artificial Sequence: Synthetic oligonucleotide
uuuuaaaaaagaguuuguuuucuuaag

SEQ ID NO: 427 - RNA, 27 nt, Artificial Sequence
  Description of Artificial Sequence: Synthetic oligonucleotide
uuuuuaaaaaagaguuuguuuucuuaa

SEQ ID NO: 428 - RNA, 27 nt, Artificial Sequence
  Description of Artificial Sequence: Synthetic oligonucleotide
auuuuuaaaaaagaguuuguuuucuua

SEQ ID NO: 429 - RNA, 27 nt, Artificial Sequence
  Description of Artificial Sequence: Synthetic oligonucleotide
aauuuuuaaaaaagaguuuguuuucuu

SEQ ID NO: 430 - RNA, 27 nt, Artificial Sequence
  Description of Artificial Sequence: Synthetic oligonucleotide
uaauuuuuaaaaaagaguuuguuuucu

SEQ ID NO: 431 - RNA, 27 nt, Artificial Sequence
  Description of Artificial Sequence: Synthetic oligonucleotide
aaaguaauuuuuaaaaaagaguuuguu

SEQ ID NO: 432 - RNA, 27 nt, Artificial Sequence
  Description of Artificial Sequence: Synthetic oligonucleotide
uauuuaaaaguaauuuuuaaaaaagag

SEQ ID NO: 433 - RNA, 27 nt, Artificial Sequence
  Description of Artificial Sequence: Synthetic oligonucleotide
auauuuaaaaguaauuuuuaaaaaaga

SEQ ID NO: 434 - RNA, 27 nt, Artificial Sequence
  Description of Artificial Sequence: Synthetic oligonucleotide
aauauuuaaaaguaauuuuuaaaaaag

SEQ ID NO: 435 - RNA, 27 nt, Artificial Sequence
  Description of Artificial Sequence: Synthetic oligonucleotide
uaauauuuaaaaguaauuuuuaaaaaa

SEQ ID NO: 436 - RNA, 27 nt, Artificial Sequence
  Description of Artificial Sequence: Synthetic oligonucleotide
uuaauauuuaaaaguaauuuuuaaaaa

SEQ ID NO: 437 - RNA, 27 nt, Artificial Sequence
  Description of Artificial Sequence: Synthetic oligonucleotide
guuaauauuuaaaaguaauuuuuaaaa

SEQ ID NO: 438 - RNA, 27 nt, Artificial Sequence
  Description of Artificial Sequence: Synthetic oligonucleotide
aguuaauauuuaaaaguaauuuuuaaa

SEQ ID NO: 439 - RNA, 27 nt, Artificial Sequence
  Description of Artificial Sequence: Synthetic oligonucleotide
gaguuaauauuuaaaaguaauuuuuaa

SEQ ID NO: 440 - RNA, 27 nt, Artificial Sequence
  Description of Artificial Sequence: Synthetic oligonucleotide
ugaguuaauauuuaaaaguaauuuuua

SEQ ID NO: 441 - RNA, 27 nt, Artificial Sequence
  Description of Artificial Sequence: Synthetic oligonucleotide
caacuuuugaguuaauauuuaaaagua

SEQ ID NO: 442 - RNA, 27 nt, Artificial Sequence
  Description of Artificial Sequence: Synthetic oligonucleotide
ucaacuuuugaguuaauauuuaaaagu

SEQ ID NO: 443 - RNA, 27 nt, Artificial Sequence
  Description of Artificial Sequence: Synthetic oligonucleotide
ucucaacuuuugaguuaauauuuaaaa

SEQ ID NO: 444 - RNA, 27 nt, Artificial Sequence
  Description of Artificial Sequence: Synthetic oligonucleotide
aaucucaacuuuugaguuaauauuuaa

SEQ ID NO: 445 - RNA, 27 nt, Artificial Sequence
  Description of Artificial Sequence: Synthetic oligonucleotide
aaaucucaacuuuugaguuaauauuua

SEQ ID NO: 446 - RNA, 27 nt, Artificial Sequence
  Description of Artificial Sequence: Synthetic oligonucleotide
aaaaucucaacuuuugaguuaauauuu

SEQ ID NO: 447 - RNA, 27 nt, Artificial Sequence
  Description of Artificial Sequence: Synthetic oligonucleotide
caaaaucucaacuuuugaguuaauauu

SEQ ID NO: 448 - RNA, 27 nt, Artificial Sequence
  Description of Artificial Sequence: Synthetic oligonucleotide
aaaaaaaaauuaaugucuuggcacacc

SEQ ID NO: 449 - RNA, 27 nt, Artificial Sequence
  Description of Artificial Sequence: Synthetic oligonucleotide
guuuaaaaaaaaaauuaaugucuuggc

SEQ ID NO: 450 - RNA, 27 nt, Artificial Sequence
  Description of Artificial Sequence: Synthetic oligonucleotide
uguuuaaaaaaaaaauuaaugucuugg

SEQ ID NO: 451 - RNA, 27 nt, Artificial Sequence
  Description of Artificial Sequence: Synthetic oligonucleotide
cuucauuguuuaaaaaaaaaauuaaug

SEQ ID NO: 452 - RNA, 27 nt, Artificial Sequence
  Description of Artificial Sequence: Synthetic oligonucleotide
acuucauuguuuaaaaaaaaaauuaau

SEQ ID NO: 453 - RNA, 27 nt, Artificial Sequence
  Description of Artificial Sequence: Synthetic oligonucleotide
ucacuucauuguuuaaaaaaaaaauua

SEQ ID NO: 454 - RNA, 27 nt, Artificial Sequence
  Description of Artificial Sequence: Synthetic oligonucleotide
uuucacuucauuguuuaaaaaaaaaau

SEQ ID NO: 455 - RNA, 27 nt, Artificial Sequence
  Description of Artificial Sequence: Synthetic oligonucleotide
uuuucacuucauuguuuaaaaaaaaaa

SEQ ID NO: 456 - RNA, 27 nt, Artificial Sequence
  Description of Artificial Sequence: Synthetic oligonucleotide
uuuuucacuucauuguuuaaaaaaaaa

SEQ ID NO: 457 - RNA, 27 nt, Artificial Sequence
  Description of Artificial Sequence: Synthetic oligonucleotide
cuuuuucacuucauuguuuaaaaaaaa

SEQ ID NO: 458 - RNA, 27 nt, Artificial Sequence
  Description of Artificial Sequence: Synthetic oligonucleotide
acuuuuucacuucauuguuuaaaaaaa

SEQ ID NO: 459 - RNA, 27 nt, Artificial Sequence
  Description of Artificial Sequence: Synthetic oligonucleotide
aaacuuuuucacuucauuguuuaaaaa

SEQ ID NO: 460 - RNA, 27 nt, Artificial Sequence
  Description of Artificial Sequence: Synthetic oligonucleotide
aaaacuuuuucacuucauuguuuaaaa

SEQ ID NO: 461 - RNA, 27 nt, Artificial Sequence
  Description of Artificial Sequence: Synthetic oligonucleotide
uaaaacuuuuucacuucauuguuuaaa

SEQ ID NO: 462 - RNA, 27 nt, Artificial Sequence
  Description of Artificial Sequence: Synthetic oligonucleotide
agagauuguaaaacuuuuucacuucau

SEQ ID NO: 463 - RNA, 27 nt, Artificial Sequence
  Description of Artificial Sequence: Synthetic oligonucleotide
aaaccuagagauuguaaaacuuuuuca

SEQ ID NO: 464 - RNA, 27 nt, Artificial Sequence
  Description of Artificial Sequence: Synthetic oligonucleotide
caaaccuagagauuguaaaacuuuuuc

SEQ ID NO: 465 - RNA, 27 nt, Artificial Sequence
  Description of Artificial Sequence: Synthetic oligonucleotide
ccaaaccuagagauuguaaaacuuuuu

SEQ ID NO: 466 - RNA, 27 nt, Artificial Sequence
  Description of Artificial Sequence: Synthetic oligonucleotide
uguuuaugcaauguuaauuuaaccagu

SEQ ID NO: 467 - RNA, 27 nt, Artificial Sequence
  Description of Artificial Sequence: Synthetic oligonucleotide
guguuuaugcaauguuaauuuaaccag

SEQ ID NO: 468 - RNA, 27 nt, Artificial Sequence
  Description of Artificial Sequence: Synthetic oligonucleotide
aguguuuaugcaauguuaauuuaacca

SEQ ID NO: 469 - RNA, 27 nt, Artificial Sequence
  Description of Artificial Sequence: Synthetic oligonucleotide
cagacuugaaaaguguuuaugcaaugu

SEQ ID NO: 470 - RNA, 27 nt, Artificial Sequence
  Description of Artificial Sequence: Synthetic oligonucleotide
gcauuauuaaauauggaucagacuuga

SEQ ID NO: 471 - RNA, 27 nt, Artificial Sequence
  Description of Artificial Sequence: Synthetic oligonucleotide
uuauuuuaaagcauuauuaaauaugga

SEQ ID NO: 472 - RNA, 27 nt, Artificial Sequence
  Description of Artificial Sequence: Synthetic oligonucleotide
uuuauuuuaaagcauuauuaaauaugg

SEQ ID NO: 473 - RNA, 27 nt, Artificial Sequence
  Description of Artificial Sequence: Synthetic oligonucleotide
uuuuauuuuaaagcauuauuaaauaug

SEQ ID NO: 474 - RNA, 27 nt, Artificial Sequence
  Description of Artificial Sequence: Synthetic oligonucleotide
uuuuuauuuuaaagcauuauuaaauau

SEQ ID NO: 475 - RNA, 27 nt, Artificial Sequence
  Description of Artificial Sequence: Synthetic oligonucleotide
auuuuuauuuuaaagcauuauuaaaua

SEQ ID NO: 476 - RNA, 27 nt, Artificial Sequence
  Description of Artificial Sequence: Synthetic oligonucleotide
uauuuuuauuuuaaagcauuauuaaau

SEQ ID NO: 477 - RNA, 27 nt, Artificial Sequence
  Description of Artificial Sequence: Synthetic oligonucleotide
uuuauuuuuauuuuaaagcauuauuaa

SEQ ID NO: 478 - RNA, 27 nt, Artificial Sequence
  Description of Artificial Sequence: Synthetic oligonucleotide
uuuuauuuuuauuuuaaagcauuauua

SEQ ID NO: 479 - RNA, 27 nt, Artificial Sequence
  Description of Artificial Sequence: Synthetic oligonucleotide
uuuuuauuuuuauuuuaaagcauuauu

SEQ ID NO: 480 - RNA, 27 nt, Artificial Sequence
  Description of Artificial Sequence: Synthetic oligonucleotide
guuuuuauuuuuauuuuaaagcauuau

SEQ ID NO: 481 - RNA, 27 nt, Artificial Sequence
  Description of Artificial Sequence: Synthetic oligonucleotide
aaggauuguuuuuauuuuuauuuuaaa

SEQ ID NO: 482 - RNA, 27 nt, Artificial Sequence
  Description of Artificial Sequence: Synthetic oligonucleotide
uaucaaaaggauuguuuuuauuuuuau

SEQ ID NO: 483 - RNA, 27 nt, Artificial Sequence
  Description of Artificial Sequence: Synthetic oligonucleotide
uuaucaaaaggauuguuuuuauuuuua

SEQ ID NO: 484 - RNA, 27 nt, Artificial Sequence
  Description of Artificial Sequence: Synthetic oligonucleotide
uuuaucaaaaggauuguuuuuauuuuu

SEQ ID NO: 485 - RNA, 27 nt, Artificial Sequence
  Description of Artificial Sequence: Synthetic oligonucleotide
auuuaucaaaaggauuguuuuuauuuu

SEQ ID NO: 486 - RNA, 27 nt, Artificial Sequence
  Description of Artificial Sequence: Synthetic oligonucleotide
aauuuaucaaaaggauuguuuuuauuu

SEQ ID NO: 487 - RNA, 27 nt, Artificial Sequence
  Description of Artificial Sequence: Synthetic oligonucleotide
aaauuuaucaaaaggauuguuuuuauu

SEQ ID NO: 488 - RNA, 27 nt, Artificial Sequence
  Description of Artificial Sequence: Synthetic oligonucleotide
uaaauuuaucaaaaggauuguuuuuau

SEQ ID NO: 489 - RNA, 27 nt, Artificial Sequence
  Description of Artificial Sequence: Synthetic oligonucleotide
uuaaauuuaucaaaaggauuguuuuua

SEQ ID NO: 490 - RNA, 27 nt, Artificial Sequence
  Description of Artificial Sequence: Synthetic oligonucleotide
cauuuuaaauuuaucaaaaggauuguu

SEQ ID NO: 491 - RNA, 27 nt, Artificial Sequence
  Description of Artificial Sequence: Synthetic oligonucleotide
aguaacauuuuaaauuuaucaaaagga

SEQ ID NO: 492 - RNA, 27 nt, Artificial Sequence
  Description of Artificial Sequence: Synthetic oligonucleotide
aaguaacauuuuaaauuuaucaaaagg

SEQ ID NO: 493 - RNA, 27 nt, Artificial Sequence
  Description of Artificial Sequence: Synthetic oligonucleotide
uaaguaacauuuuaaauuuaucaaaag

SEQ ID NO: 494 - RNA, 27 nt, Artificial Sequence
  Description of Artificial Sequence: Synthetic oligonucleotide
aaaauaaguaacauuuuaaauuuauca

SEQ ID NO: 495 - RNA, 27 nt, Artificial Sequence
  Description of Artificial Sequence: Synthetic oligonucleotide
uaaaauaaguaacauuuuaaauuuauc

SEQ ID NO: 496 - RNA, 27 nt, Artificial Sequence
  Description of Artificial Sequence: Synthetic oligonucleotide
uuaaaauaaguaacauuuuaaauuuau

SEQ ID NO: 497 - RNA, 27 nt, Artificial Sequence
  Description of Artificial Sequence: Synthetic oligonucleotide
uuuaaaauaaguaacauuuuaaauuua

SEQ ID NO: 498 - RNA, 27 nt, Artificial Sequence
  Description of Artificial Sequence: Synthetic oligonucleotide
uuuuaaaauaaguaacauuuuaaauuu

SEQ ID NO: 499 - RNA, 27 nt, Artificial Sequence
  Description of Artificial Sequence: Synthetic oligonucleotide
auuuuaaaauaaguaacauuuuaaauu

SEQ ID NO: 500 - RNA, 27 nt, Artificial Sequence
  Description of Artificial Sequence: Synthetic oligonucleotide
uuauuuuaaaauaaguaacauuuuaaa

SEQ ID NO: 501 - RNA, 27 nt, Artificial Sequence
  Description of Artificial Sequence: Synthetic oligonucleotide
uuuauuuuaaaauaaguaacauuuuaa

SEQ ID NO: 502 - RNA, 27 nt, Artificial Sequence
  Description of Artificial Sequence: Synthetic oligonucleotide
auuuauuuuaaaauaaguaacauuuua

SEQ ID NO: 503 - RNA, 27 nt, Artificial Sequence
  Description of Artificial Sequence: Synthetic oligonucleotide
cauuuauuuuaaaauaaguaacauuuu

SEQ ID NO: 504 - RNA, 27 nt, Artificial Sequence
  Description of Artificial Sequence: Synthetic oligonucleotide
ucauuuauuuuaaaauaaguaacauuu

SEQ ID NO: 505 - RNA, 27 nt, Artificial Sequence
  Description of Artificial Sequence: Synthetic oligonucleotide
cuucauuuauuuuaaaauaaguaacau

SEQ ID NO: 506 - RNA, 27 nt, Artificial Sequence
  Description of Artificial Sequence: Synthetic oligonucleotide
ucucacuucauuuauuuuaaaauaagu

SEQ ID NO: 507 - RNA, 27 nt, Artificial Sequence
  Description of Artificial Sequence: Synthetic oligonucleotide
caucucacuucauuuauuuuaaaauaa

SEQ ID NO: 508 - RNA, 27 nt, Artificial Sequence
  Description of Artificial Sequence: Synthetic oligonucleotide
ccaucucacuucauuuauuuuaaaaua

SEQ ID NO: 509 - RNA, 27 nt, Artificial Sequence
  Description of Artificial Sequence: Synthetic oligonucleotide
augccaucucacuucauuuauuuuaaa

SEQ ID NO: 510 - RNA, 27 nt, Artificial Sequence
  Description of Artificial Sequence: Synthetic oligonucleotide
caugccaucucacuucauuuauuuuaa

SEQ ID NO: 511 - RNA, 27 nt, Artificial Sequence
  Description of Artificial Sequence: Synthetic oligonucleotide
ugacuucuuuuaacaugaagaaaugga

SEQ ID NO: 512 - RNA, 27 nt, Artificial Sequence
  Description of Artificial Sequence: Synthetic oligonucleotide
augacuucuuuuaacaugaagaaaugg

SEQ ID NO: 513 - RNA, 27 nt, Artificial Sequence
  Description of Artificial Sequence: Synthetic oligonucleotide
guaaaaaaaaaaaacuaagaguuugag

SEQ ID NO: 514 - RNA, 27 nt, Artificial Sequence
  Description of Artificial Sequence: Synthetic oligonucleotide
uuacauaguuguaaaaaaaaaaaacua

SEQ ID NO: 515 - RNA, 27 nt, Artificial Sequence
  Description of Artificial Sequence: Synthetic oligonucleotide
auuacauaguuguaaaaaaaaaaaacu

SEQ ID NO: 516 - RNA, 27 nt, Artificial Sequence
  Description of Artificial Sequence: Synthetic oligonucleotide
aauuacauaguuguaaaaaaaaaaaac

SEQ ID NO: 517 - RNA, 27 nt, Artificial Sequence
  Description of Artificial Sequence: Synthetic oligonucleotide
aaauuacauaguuguaaaaaaaaaaaa

SEQ ID NO: 518 - RNA, 27 nt, Artificial Sequence
  Description of Artificial Sequence: Synthetic oligonucleotide
uaaauuacauaguuguaaaaaaaaaaa

SEQ ID NO: 519 - RNA, 27 nt, Artificial Sequence
  Description of Artificial Sequence: Synthetic oligonucleotide
auaaauuacauaguuguaaaaaaaaaa

SEQ ID NO: 520 - RNA, 27 nt, Artificial Sequence
  Description of Artificial Sequence: Synthetic oligonucleotide
uauaaauuacauaguuguaaaaaaaaa

SEQ ID NO: 521 - RNA, 27 nt, Artificial Sequence
  Description of Artificial Sequence: Synthetic oligonucleotide
auauaaauuacauaguuguaaaaaaaa

SEQ ID NO: 522 - RNA, 27 nt, Artificial Sequence
  Description of Artificial Sequence: Synthetic oligonucleotide
aauauaaauuacauaguuguaaaaaaa

SEQ ID NO: 523 - RNA, 27 nt, Artificial Sequence
  Description of Artificial Sequence: Synthetic oligonucleotide
gaauauaaauuacauaguuguaaaaaa

SEQ ID NO: 524 - RNA, 27 nt, Artificial Sequence
  Description of Artificial Sequence: Synthetic oligonucleotide
ggaauauaaauuacauaguuguaaaaa

SEQ ID NO: 525 - RNA, 27 nt, Artificial Sequence
  Description of Artificial Sequence: Synthetic oligonucleotide
uguaaauggaauauaaauuacauaguu

SEQ ID NO: 526 - RNA, 27 nt, Artificial Sequence
  Description of Artificial Sequence: Synthetic oligonucleotide
auguaaauggaauauaaauuacauagu

SEQ ID NO: 527 - RNA, 27 nt, Artificial Sequence
  Description of Artificial Sequence: Synthetic oligonucleotide
uauguaaauggaauauaaauuacauag

SEQ ID NO: 528 - RNA, 27 nt, Artificial Sequence
  Description of Artificial Sequence: Synthetic oligonucleotide
uauccuuauguaaauggaauauaaauu

SEQ ID NO: 529 - RNA, 27 nt, Artificial Sequence
  Description of Artificial Sequence: Synthetic oligonucleotide
guauccuuauguaaauggaauauaaau

SEQ ID NO: 530 - RNA, 27 nt, Artificial Sequence
  Description of Artificial Sequence: Synthetic oligonucleotide
uguauccuuauguaaauggaauauaaa

SEQ ID NO: 531 - RNA, 27 nt, Artificial Sequence
  Description of Artificial Sequence: Synthetic oligonucleotide
guguauccuuauguaaauggaauauaa

SEQ ID NO: 532 - RNA, 27 nt, Artificial Sequence
  Description of Artificial Sequence: Synthetic oligonucleotide
cuugacaaauaaguguauccuuaugua

SEQ ID NO: 533 - RNA, 27 nt, Artificial Sequence
  Description of Artificial Sequence: Synthetic oligonucleotide
ugagcuugacaaauaaguguauccuua

SEQ ID NO: 534 - RNA, 27 nt, Artificial Sequence
  Description of Artificial Sequence: Synthetic oligonucleotide
uguaacauagguuaaaaauuuacagau

SEQ ID NO: 535 - RNA, 27 nt, Artificial Sequence
  Description of Artificial Sequence: Synthetic oligonucleotide
guguaacauagguuaaaaauuuacaga

SEQ ID NO: 536 - RNA, 27 nt, Artificial Sequence
  Description of Artificial Sequence: Synthetic oligonucleotide
gguguaacauagguuaaaaauuuacag

SEQ ID NO: 537 - RNA, 27 nt, Artificial Sequence
  Description of Artificial Sequence: Synthetic oligonucleotide
auucaaauauaaacuucaccucuugca

SEQ ID NO: 538 - RNA, 27 nt, Artificial Sequence
  Description of Artificial Sequence: Synthetic oligonucleotide
auauucaaauauaaacuucaccucuug

SEQ ID NO: 539 - RNA, 27 nt, Artificial Sequence
  Description of Artificial Sequence: Synthetic oligonucleotide
gauauucaaauauaaacuucaccucuu

SEQ ID NO: 540 - RNA, 27 nt, Artificial Sequence
  Description of Artificial Sequence: Synthetic oligonucleotide
uggauauucaaauauaaacuucaccuc

SEQ ID NO: 541 - RNA, 27 nt, Artificial Sequence
  Description of Artificial Sequence: Synthetic oligonucleotide
auggauauucaaauauaaacuucaccu

SEQ ID NO: 542 - RNA, 27 nt, Artificial Sequence
  Description of Artificial Sequence: Synthetic oligonucleotide
cgagaauggauauucaaauauaaacuu

SEQ ID NO: 543 - RNA, 27 nt, Artificial Sequence
  Description of Artificial Sequence: Synthetic oligonucleotide
auuacaaguauuaaaacugcaucaagu

SEQ ID NO: 544 - RNA, 27 nt, Artificial Sequence
  Description of Artificial Sequence: Synthetic oligonucleotide
gaauuacaaguauuaaaacugcaucaa

SEQ ID NO: 545 - RNA, 27 nt, Artificial Sequence
  Description of Artificial Sequence: Synthetic oligonucleotide
ccugaaaauuagugauuaggucaaauc

SEQ ID NO: 546 - RNA, 27 nt, Artificial Sequence
  Description of Artificial Sequence: Synthetic oligonucleotide
ccaccaccugaaaauuagugauuaggu

SEQ ID NO: 547 - RNA, 27 nt, Artificial Sequence
  Description of Artificial Sequence: Synthetic oligonucleotide
ucauaccagguuugaaaaauccuacug

SEQ ID NO: 548 - RNA, 27 nt, Artificial Sequence
  Description of Artificial Sequence: Synthetic oligonucleotide
cuaucuuuauuaaauucuccuuccacu

SEQ ID NO: 549 - RNA, 27 nt, Artificial Sequence
  Description of Artificial Sequence: Synthetic oligonucleotide
gcacuaucuuuauuaaauucuccuucc

SEQ ID NO: 550 - RNA, 27 nt, Artificial Sequence
  Description of Artificial Sequence: Synthetic oligonucleotide
cagcacuaucuuuauuaaauucuccuu

SEQ ID NO: 551 - RNA, 27 nt, Artificial Sequence
  Description of Artificial Sequence: Synthetic oligonucleotide
ucagcacuaucuuuauuaaauucuccu

SEQ ID NO: 552 - RNA, 27 nt, Artificial Sequence
  Description of Artificial Sequence: Synthetic oligonucleotide
ucuuucagcacuaucuuuauuaaauuc

SEQ ID NO: 553 - RNA, 27 nt, Artificial Sequence
  Description of Artificial Sequence: Synthetic oligonucleotide
uaguccuaguuauagauuaccuaagga

SEQ ID NO: 554 - RNA, 27 nt, Artificial Sequence
  Description of Artificial Sequence: Synthetic oligonucleotide
guaguccuaguuauagauuaccuaagg

SEQ ID NO: 555 - RNA, 27 nt, Artificial Sequence
  Description of Artificial Sequence: Synthetic oligonucleotide
acuaaaacaauggaauguauuacuguu

SEQ ID NO: 556 - RNA, 27 nt, Artificial Sequence
  Description of Artificial Sequence: Synthetic oligonucleotide
uuacuaaaacaauggaauguauuacug

SEQ ID NO: 557 - RNA, 27 nt, Artificial Sequence
  Description of Artificial Sequence: Synthetic oligonucleotide
guuacuaaaacaauggaauguauuacu

SEQ ID NO: 558 - RNA, 27 nt, Artificial Sequence
  Description of Artificial Sequence: Synthetic oligonucleotide
gguuacuaaaacaauggaauguauuac

SEQ ID NO: 559 - RNA, 27 nt, Artificial Sequence
  Description of Artificial Sequence: Synthetic oligonucleotide
gaagauuucugguuacuaaaacaaugg

SEQ ID NO: 560 - RNA, 27 nt, Artificial Sequence
  Description of Artificial Sequence: Synthetic oligonucleotide
auuuuucauugcaugaagauuucuggu

SEQ ID NO: 561 - RNA, 27 nt, Artificial Sequence
  Description of Artificial Sequence: Synthetic oligonucleotide
gaauuaaaguauuuuucauugcaugaa

SEQ ID NO: 562 - RNA, 27 nt, Artificial Sequence
  Description of Artificial Sequence: Synthetic oligonucleotide
gcuucaugaauuaaaguauuuuucauu

SEQ ID NO: 563 - RNA, 27 nt, Artificial Sequence
  Description of Artificial Sequence: Synthetic oligonucleotide
aagcuucaugaauuaaaguauuuuuca

SEQ ID NO: 564 - RNA, 27 nt, Artificial Sequence
  Description of Artificial Sequence: Synthetic oligonucleotide
uaagcuucaugaauuaaaguauuuuuc

SEQ ID NO: 565 - RNA, 27 nt, Artificial Sequence
  Description of Artificial Sequence: Synthetic oligonucleotide
ccaaaaaaaaaaaguaagcuucaugaa

SEQ ID NO: 566 - RNA, 27 nt, Artificial Sequence
  Description of Artificial Sequence: Synthetic oligonucleotide
acaccaaaaaaaaaaaguaagcuucau

SEQ ID NO: 567 - RNA, 27 nt, Artificial Sequence
  Description of Artificial Sequence: Synthetic oligonucleotide
ucugacaccaaaaaaaaaaaguaagcu

SEQ ID NO: 568 - RNA, 27 nt, Artificial Sequence
  Description of Artificial Sequence: Synthetic oligonucleotide
agacucugacaccaaaaaaaaaaagua

SEQ ID NO: 569 - RNA, 27 nt, Artificial Sequence
  Description of Artificial Sequence: Synthetic oligonucleotide
gagacucugacaccaaaaaaaaaaagu

SEQ ID NO: 570 - RNA, 27 nt, Artificial Sequence
  Description of Artificial Sequence: Synthetic oligonucleotide
ucucuccuaaaaauacaaaaauuaguu

SEQ ID NO: 571 - RNA, 27 nt, Artificial Sequence
  Description of Artificial Sequence: Synthetic oligonucleotide
ccgucucuccuaaaaauacaaaaauua

SEQ ID NO: 572 - RNA, 27 nt, Artificial Sequence
  Description of Artificial Sequence: Synthetic oligonucleotide
ucaauaaauauuugcugaauaaaugag

SEQ ID NO: 573 - RNA, 27 nt, Artificial Sequence
  Description of Artificial Sequence: Synthetic oligonucleotide
acucaauaaauauuugcugaauaaaug

SEQ ID NO: 574 - RNA, 27 nt, Artificial Sequence
  Description of Artificial Sequence: Synthetic oligonucleotide
gcacucaauaaauauuugcugaauaaa

SEQ ID NO: 575 - RNA, 27 nt, Artificial Sequence
  Description of Artificial Sequence: Synthetic oligonucleotide
aaaccccuucuuugcaaaacuaaaaua

SEQ ID NO: 576 - RNA, 27 nt, Artificial Sequence
  Description of Artificial Sequence: Synthetic oligonucleotide
uggaaucguagcaaaacaauuauagag

SEQ ID NO: 577 - RNA, 27 nt, Artificial Sequence
  Description of Artificial Sequence: Synthetic oligonucleotide
aaacaaugaagugauuuacauaaagua

SEQ ID NO: 578 - RNA, 27 nt, Artificial Sequence
  Description of Artificial Sequence: Synthetic oligonucleotide
aaaacaaugaagugauuuacauaaagu

SEQ ID NO: 579 - RNA, 27 nt, Artificial Sequence
  Description of Artificial Sequence: Synthetic oligonucleotide
uaaaacaaugaagugauuuacauaaag

SEQ ID NO: 580 - RNA, 27 nt, Artificial Sequence
  Description of Artificial Sequence: Synthetic oligonucleotide
uuaaaacaaugaagugauuuacauaaa

SEQ ID NO: 581 - RNA, 27 nt, Artificial Sequence
  Description of Artificial Sequence: Synthetic oligonucleotide
uuuaaaacaaugaagugauuuacauaa

SEQ ID NO: 582 - RNA, 27 nt, Artificial Sequence
  Description of Artificial Sequence: Synthetic oligonucleotide
cuuuaaaacaaugaagugauuuacaua

SEQ ID NO: 583 - RNA, 27 nt, Artificial Sequence
  Description of Artificial Sequence: Synthetic oligonucleotide
ccuuuaaaacaaugaagugauuuacau

SEQ ID NO: 584 - RNA, 27 nt, Artificial Sequence
  Description of Artificial Sequence: Synthetic oligonucleotide
uaaucaaguuuauuccuuuaaaacaau

SEQ ID NO: 585 - RNA, 27 nt, Artificial Sequence
  Description of Artificial Sequence: Synthetic oligonucleotide
auaaucaaguuuauuccuuuaaaacaa

SEQ ID NO: 586 - RNA, 27 nt, Artificial Sequence
  Description of Artificial Sequence: Synthetic oligonucleotide
aauauaaucaaguuuauuccuuuaaaa

SEQ ID NO: 587 - RNA, 27 nt, Artificial Sequence
  Description of Artificial Sequence: Synthetic oligonucleotide
caauauaaucaaguuuauuccuuuaaa

SEQ ID NO: 588 - RNA, 27 nt, Artificial Sequence
  Description of Artificial Sequence: Synthetic oligonucleotide
acaauauaaucaaguuuauuccuuuaa

SEQ ID NO: 589 - RNA, 27 nt, Artificial Sequence
  Description of Artificial Sequence: Synthetic oligonucleotide
aaacaauauaaucaaguuuauuccuuu

SEQ ID NO: 590 - RNA, 27 nt, Artificial Sequence
  Description of Artificial Sequence: Synthetic oligonucleotide
aaaacaauauaaucaaguuuauuccuu

SEQ ID NO: 591 - RNA, 27 nt, Artificial Sequence
  Description of Artificial Sequence: Synthetic oligonucleotide
aaaaacaauauaaucaaguuuauuccu

SEQ ID NO: 592 - RNA, 27 nt, Artificial Sequence
  Description of Artificial Sequence: Synthetic oligonucleotide
aaaaaacaauauaaucaaguuuauucc

SEQ ID NO: 593 - RNA, 27 nt, Artificial Sequence
  Description of Artificial Sequence: Synthetic oligonucleotide
aaaaaaacaauauaaucaaguuuauuc

SEQ ID NO: 594 - RNA, 27 nt, Artificial Sequence
  Description of Artificial Sequence: Synthetic oligonucleotide
caaauaaaaaaacaauauaaucaaguu

SEQ ID NO: 595 - RNA, 27 nt, Artificial Sequence
  Description of Artificial Sequence: Synthetic oligonucleotide
ccaaauaaaaaaacaauauaaucaagu

SEQ ID NO: 596 - RNA, 27 nt, Artificial Sequence
  Description of Artificial Sequence: Synthetic oligonucleotide
augccaaauaaaaaaacaauauaauca

SEQ ID NO: 597 - RNA, 27 nt, Artificial Sequence
  Description of Artificial Sequence: Synthetic oligonucleotide
caguuaugccaaauaaaaaaacaauau

SEQ ID NO: 598 - RNA, 27 nt, Artificial Sequence
  Description of Artificial Sequence: Synthetic oligonucleotide
acaguuaugccaaauaaaaaaacaaua

SEQ ID NO: 599 - RNA, 27 nt, Artificial Sequence
  Description of Artificial Sequence: Synthetic oligonucleotide
gaaucacaguuaugccaaauaaaaaaa

SEQ ID NO: 600 - RNA, 27 nt, Artificial Sequence
  Description of Artificial Sequence: Synthetic oligonucleotide
gaaucacaguuaugccaaauaaaaaaa

SEQ ID NO: 601 - RNA, 27 nt, Artificial Sequence
  Description of Artificial Sequence: Synthetic oligonucleotide
auuguccuaaaagaaucacaguuaugc

SEQ ID NO: 602 - RNA, 27 nt, Artificial Sequence
  Description of Artificial Sequence: Synthetic oligonucleotide
caguaauuguccuaaaagaaucacagu

SEQ ID NO: 603 - RNA, 27 nt, Artificial Sequence
  Description of Artificial Sequence: Synthetic oligonucleotide
acaguaauuguccuaaaagaaucacag

SEQ ID NO: 604 - RNA, 27 nt, Artificial Sequence
  Description of Artificial Sequence: Synthetic oligonucleotide
ggucaauaugaauaucugacauacacc

SEQ ID NO: 605 - RNA, 27 nt, Artificial Sequence
  Description of Artificial Sequence: Synthetic oligonucleotide
gggucaauaugaauaucugacauacac

SEQ ID NO: 606 - RNA, 27 nt, Artificial Sequence
  Description of Artificial Sequence: Synthetic oligonucleotide
agagaaaacuggaauauuacacauuug

SEQ ID NO: 607 - RNA, 27 nt, Artificial Sequence
  Description of Artificial Sequence: Synthetic oligonucleotide
uuuuuaaguauauuuuaauuacuuaug

SEQ ID NO: 608 - RNA, 27 nt, Artificial Sequence
  Description of Artificial Sequence: Synthetic oligonucleotide
auuuuuaaguauauuuuaauuacuuau

SEQ ID NO: 609 - RNA, 27 nt, Artificial Sequence
  Description of Artificial Sequence: Synthetic oligonucleotide
aauuuuuaaguauauuuuaauuacuua

SEQ ID NO: 610 - RNA, 27 nt, Artificial Sequence
  Description of Artificial Sequence: Synthetic oligonucleotide
uaauuuuuaaguauauuuuaauuacuu

SEQ ID NO: 611 - RNA, 27 nt, Artificial Sequence
  Description of Artificial Sequence: Synthetic oligonucleotide
uuaauuuuuaaguauauuuuaauuacu

SEQ ID NO: 612 - RNA, 27 nt, Artificial Sequence
  Description of Artificial Sequence: Synthetic oligonucleotide
auuaauuuuuaaguauauuuuaauuac

SEQ ID NO: 613 - RNA, 27 nt, Artificial Sequence
  Description of Artificial Sequence: Synthetic oligonucleotide
uauuaauuuuuaaguauauuuuaauua

SEQ ID NO: 614 - RNA, 27 nt, Artificial Sequence
  Description of Artificial Sequence: Synthetic oligonucleotide
cuauuaauuuuuaaguauauuuuaauu

SEQ ID NO: 615 - RNA, 27 nt, Artificial Sequence
  Description of Artificial Sequence: Synthetic oligonucleotide
acuauuaauuuuuaaguauauuuuaau

SEQ ID NO: 616 - RNA, 27 nt, Artificial Sequence
  Description of Artificial Sequence: Synthetic oligonucleotide
aaacuauuaauuuuuaaguauauuuua

SEQ ID NO: 617 - RNA, 27 nt, Artificial Sequence
  Description of Artificial Sequence: Synthetic oligonucleotide
aaaacuauuaauuuuuaaguauauuuu

SEQ ID NO: 618 - RNA, 27 nt, Artificial Sequence
  Description of Artificial Sequence: Synthetic oligonucleotide
uaaaacuauuaauuuuuaaguauauuu

SEQ ID NO: 619 - RNA, 27 nt, Artificial Sequence
  Description of Artificial Sequence: Synthetic oligonucleotide
auaaaacuauuaauuuuuaaguauauu

SEQ ID NO: 620 - RNA, 27 nt, Artificial Sequence
  Description of Artificial Sequence: Synthetic oligonucleotide
ccagauaaaacuauuaauuuuuaagua

SEQ ID NO: 621 - RNA, 27 nt, Artificial Sequence
  Description of Artificial Sequence: Synthetic oligonucleotide
guacccagauaaaacuauuaauuuuua

SEQ ID NO: 622 - RNA, 27 nt, Artificial Sequence
  Description of Artificial Sequence: Synthetic oligonucleotide
uguacccagauaaaacuauuaauuuuu

SEQ ID NO: 623 - RNA, 27 nt, Artificial Sequence
  Description of Artificial Sequence: Synthetic oligonucleotide
uuguacccagauaaaacuauuaauuuu

SEQ ID NO: 624 - RNA, 27 nt, Artificial Sequence
  Description of Artificial Sequence: Synthetic oligonucleotide
caggcaccuguuuauuuguacccagau

SEQ ID NO: 625 - RNA, 27 nt, Artificial Sequence
  Description of Artificial Sequence: Synthetic oligonucleotide
ugauuuuuacauagaaguuuccuuguc

SEQ ID NO: 626 - RNA, 27 nt, Artificial Sequence
  Description of Artificial Sequence: Synthetic oligonucleotide
gugauuuuuacauagaaguuuccuugu

SEQ ID NO: 627 - RNA, 27 nt, Artificial Sequence
  Description of Artificial Sequence: Synthetic oligonucleotide
agugauuuuuacauagaaguuuccuug

SEQ ID NO: 628 - RNA, 27 nt, Artificial Sequence
  Description of Artificial Sequence: Synthetic oligonucleotide
agaaaucauagugauuuuuacauagaa

SEQ ID NO: 629 - RNA, 27 nt, Artificial Sequence
  Description of Artificial Sequence: Synthetic oligonucleotide
cagaaaucauagugauuuuuacauaga

SEQ ID NO: 630 - RNA, 27 nt, Artificial Sequence
  Description of Artificial Sequence: Synthetic oligonucleotide
ucagaaaucauagugauuuuuacauag

SEQ ID NO: 631 - RNA, 27 nt, Artificial Sequence
  Description of Artificial Sequence: Synthetic oligonucleotide
caauucagaaaucauagugauuuuuac

SEQ ID NO: 632 - RNA, 27 nt, Artificial Sequence
  Description of Artificial Sequence: Synthetic oligonucleotide
gcaauucagaaaucauagugauuuuua

SEQ ID NO: 633 - RNA, 27 nt, Artificial Sequence
  Description of Artificial Sequence: Synthetic oligonucleotide
uuucacauagcaauucagaaaucauag

SEQ ID NO: 634 - RNA, 27 nt, Artificial Sequence
  Description of Artificial Sequence: Synthetic oligonucleotide
guuucacauagcaauucagaaaucaua

SEQ ID NO: 635 - RNA, 27 nt, Artificial Sequence
  Description of Artificial Sequence: Synthetic oligonucleotide
uguuccaaagaucuguaguuucacaua

SEQ ID NO: 636 - RNA, 27 nt, Artificial Sequence
  Description of Artificial Sequence: Synthetic oligonucleotide
guguuccaaagaucuguaguuucacau

SEQ ID NO: 637 - RNA, 27 nt, Artificial Sequence
  Description of Artificial Sequence: Synthetic oligonucleotide
gagguacuguguaagucuuaacacccu

SEQ ID NO: 638 - RNA, 27 nt, Artificial Sequence
  Description of Artificial Sequence: Synthetic oligonucleotide
cuacaucaaaaauucaagaggccuaaa

SEQ ID NO: 639 - RNA, 27 nt, Artificial Sequence
  Description of Artificial Sequence: Synthetic oligonucleotide
augcccaucuacaucaaaaauucaaga

SEQ ID NO: 640 - RNA, 27 nt, Artificial Sequence
  Description of Artificial Sequence: Synthetic oligonucleotide
aaugcccaucuacaucaaaaauucaag

SEQ ID NO: 641 - RNA, 27 nt, Artificial Sequence
  Description of Artificial Sequence: Synthetic oligonucleotide
ccacuaccuuaaaaaaaugcccaucua

SEQ ID NO: 642 - RNA, 27 nt, Artificial Sequence
  Description of Artificial Sequence: Synthetic oligonucleotide
aauuaaccacuaccuuaaaaaaaugcc

SEQ ID NO: 643 - RNA, 27 nt, Artificial Sequence
  Description of Artificial Sequence: Synthetic oligonucleotide
ucacauaaagguaauuaaccacuaccu

SEQ ID NO: 644 - RNA, 27 nt, Artificial Sequence
  Description of Artificial Sequence: Synthetic oligonucleotide
guucacauaaagguaauuaaccacuac

SEQ ID NO: 645 - RNA, 27 nt, Artificial Sequence
  Description of Artificial Sequence: Synthetic oligonucleotide
aguucacauaaagguaauuaaccacua

SEQ ID NO: 646 - RNA, 27 nt, Artificial Sequence
  Description of Artificial Sequence: Synthetic oligonucleotide
aaguucacauaaagguaauuaaccacu

SEQ ID NO: 647 - RNA, 27 nt, Artificial Sequence
  Description of Artificial Sequence: Synthetic oligonucleotide
aaaguucacauaaagguaauuaaccac

SEQ ID NO: 648 - RNA, 27 nt, Artificial Sequence
  Description of Artificial Sequence: Synthetic oligonucleotide
uaaaccauucaaaguucacauaaaggu

SEQ ID NO: 649 - RNA, 27 nt, Artificial Sequence
  Description of Artificial Sequence: Synthetic oligonucleotide
uuuguuaaaccauucaaaguucacaua

SEQ ID NO: 650 - RNA, 27 nt, Artificial Sequence
  Description of Artificial Sequence: Synthetic oligonucleotide
aaaucuuuuguuaaaccauucaaaguu

SEQ ID NO: 651 - RNA, 27 nt, Artificial Sequence
  Description of Artificial Sequence: Synthetic oligonucleotide
aaacaaaucuuuuguuaaaccauucaa

SEQ ID NO: 652 - RNA, 27 nt, Artificial Sequence
  Description of Artificial Sequence: Synthetic oligonucleotide
aaaacaaaucuuuuguuaaaccauuca

SEQ ID NO: 653 - RNA, 27 nt, Artificial Sequence
  Description of Artificial Sequence: Synthetic oligonucleotide
aaaaacaaaucuuuuguuaaaccauuc

SEQ ID NO: 654 - RNA, 27 nt, Artificial Sequence
  Description of Artificial Sequence: Synthetic oligonucleotide
caaaaacaaaucuuuuguuaaaccauu

SEQ ID NO: 655 - RNA, 27 nt, Artificial Sequence
  Description of Artificial Sequence: Synthetic oligonucleotide
acaaaaacaaaucuuuuguuaaaccau

SEQ ID NO: 656 - RNA, 27 nt, Artificial Sequence
  Description of Artificial Sequence: Synthetic oligonucleotide
cuacaaaaacaaaucuuuuguuaaacc

SEQ ID NO: 657 - RNA, 27 nt, Artificial Sequence
  Description of Artificial Sequence: Synthetic oligonucleotide
ucuacaaaaacaaaucuuuuguuaaac

SEQ ID NO: 658 - RNA, 27 nt, Artificial Sequence
  Description of Artificial Sequence: Synthetic oligonucleotide
aaucucuacaaaaacaaaucuuuuguu

SEQ ID NO: 659 - RNA, 27 nt, Artificial Sequence
  Description of Artificial Sequence: Synthetic oligonucleotide
aaaucucuacaaaaacaaaucuuuugu

SEQ ID NO: 660 - RNA, 27 nt, Artificial Sequence
  Description of Artificial Sequence: Synthetic oligonucleotide
aaaaucucuacaaaaacaaaucuuuug

SEQ ID NO: 661 - RNA, 27 nt, Artificial Sequence
  Description of Artificial Sequence: Synthetic oligonucleotide
uuaaaaucucuacaaaaacaaaucuuu

SEQ ID NO: 662 - RNA, 27 nt, Artificial Sequence
  Description of Artificial Sequence: Synthetic oligonucleotide
uuuaaaaucucuacaaaaacaaaucuu

SEQ ID NO: 663 - RNA, 27 nt, Artificial Sequence
  Description of Artificial Sequence: Synthetic oligonucleotide
cuuuaaaaucucuacaaaaacaaaucu

SEQ ID NO: 664 - RNA, 27 nt, Artificial Sequence
  Description of Artificial Sequence: Synthetic oligonucleotide
ccuuuaaaaucucuacaaaaacaaauc

SEQ ID NO: 665 - RNA, 27 nt, Artificial Sequence
  Description of Artificial Sequence: Synthetic oligonucleotide
ucucccccuuuaaaaucucuacaaaaa

SEQ ID NO: 666 - RNA, 27 nt, Artificial Sequence
  Description of Artificial Sequence: Synthetic oligonucleotide
acauuuauuucuagaauucucccccuu

SEQ ID NO: 667 - RNA, 27 nt, Artificial Sequence
  Description of Artificial Sequence: Synthetic oligonucleotide
uaacauuuauuucuagaauucuccccc

SEQ ID NO: 668 - RNA, 27 nt, Artificial Sequence
  Description of Artificial Sequence: Synthetic oligonucleotide
guaacauuuauuucuagaauucucccc

SEQ ID NO: 669 - RNA, 27 nt, Artificial Sequence
  Description of Artificial Sequence: Synthetic oligonucleotide
gguaacauuuauuucuagaauucuccc

SEQ ID NO: 670 - RNA, 27 nt, Artificial Sequence
  Description of Artificial Sequence: Synthetic oligonucleotide
agguaacauuuauuucuagaauucucc

SEQ ID NO: 671 - RNA, 27 nt, Artificial Sequence
  Description of Artificial Sequence: Synthetic oligonucleotide
uagguaacauuuauuucuagaauucuc

SEQ ID NO: 672 - RNA, 27 nt, Artificial Sequence
  Description of Artificial Sequence: Synthetic oligonucleotide
auaauuagguaacauuuauuucuagaa

SEQ ID NO: 673 - RNA, 27 nt, Artificial Sequence
  Description of Artificial Sequence: Synthetic oligonucleotide
aauaauuagguaacauuuauuucuaga

SEQ ID NO: 674 - RNA, 27 nt, Artificial Sequence
  Description of Artificial Sequence: Synthetic oligonucleotide
uaauaauuagguaacauuuauuucuag

SEQ ID NO: 675 - RNA, 27 nt, Artificial Sequence
  Description of Artificial Sequence: Synthetic oligonucleotide
guaauaauuagguaacauuuauuucua

SEQ ID NO: 676 - RNA, 27 nt, Artificial Sequence
  Description of Artificial Sequence: Synthetic oligonucleotide
uguaauaauuagguaacauuuauuucu

SEQ ID NO: 677 - RNA, 27 nt, Artificial Sequence
  Description of Artificial Sequence: Synthetic oligonucleotide
gcuguaauaauuagguaacauuuauuu

SEQ ID NO: 678 - RNA, 27 nt, Artificial Sequence
  Description of Artificial Sequence: Synthetic oligonucleotide
uugucuuuaaggcuguaauaauuaggu

SEQ ID NO: 679 - RNA, 27 nt, Artificial Sequence
  Description of Artificial Sequence: Synthetic oligonucleotide
uuugucuuuaaggcuguaauaauuagg

SEQ ID NO: 680 - RNA, 27 nt, Artificial Sequence
  Description of Artificial Sequence: Synthetic oligonucleotide
cuucaacaaggauuuuugucuuuaagg

SEQ ID NO: 681 - RNA, 27 nt, Artificial Sequence
  Description of Artificial Sequence: Synthetic oligonucleotide
aaacuucaacaaggauuuuugucuuua

SEQ ID NO: 682 - RNA, 27 nt, Artificial Sequence
  Description of Artificial Sequence: Synthetic oligonucleotide
cuuuuuuuaaaaaaacuucaacaagga

SEQ ID NO: 683 - RNA, 27 nt, Artificial Sequence
  Description of Artificial Sequence: Synthetic oligonucleotide
gcuuuuuuuaaaaaaacuucaacaagg

SEQ ID NO: 684 - RNA, 27 nt, Artificial Sequence
  Description of Artificial Sequence: Synthetic oligonucleotide
uagcuuuuuuuaaaaaaacuucaacaa

SEQ ID NO: 685 - RNA, 27 nt, Artificial Sequence
  Description of Artificial Sequence: Synthetic oligonucleotide
uuagcuuuuuuuaaaaaaacuucaaca

SEQ ID NO: 686 - RNA, 27 nt, Artificial Sequence
  Description of Artificial Sequence: Synthetic oligonucleotide
uaauuuagcuuuuuuuaaaaaaacuuc

SEQ ID NO: 687 - RNA, 27 nt, Artificial Sequence
  Description of Artificial Sequence: Synthetic oligonucleotide
guaauuuagcuuuuuuuaaaaaaacuu

SEQ ID NO: 688 - RNA, 27 nt, Artificial Sequence
  Description of Artificial Sequence: Synthetic oligonucleotide
uguaauuuagcuuuuuuuaaaaaaacu

SEQ ID NO: 689 - RNA, 27 nt, Artificial Sequence
  Description of Artificial Sequence: Synthetic oligonucleotide
auguaauuuagcuuuuuuuaaaaaaac

SEQ ID NO: 690 - RNA, 27 nt, Artificial Sequence
  Description of Artificial Sequence: Synthetic oligonucleotide
uauguaauuuagcuuuuuuuaaaaaaa

SEQ ID NO: 691 - RNA, 27 nt, Artificial Sequence
  Description of Artificial Sequence: Synthetic oligonucleotide
agucuauguaauuuagcuuuuuuuaaa

SEQ ID NO: 692 - RNA, 27 nt, Artificial Sequence
  Description of Artificial Sequence: Synthetic oligonucleotide
uaagucuauguaauuuagcuuuuuuua

SEQ ID NO: 693 - RNA, 27 nt, Artificial Sequence
  Description of Artificial Sequence: Synthetic oligonucleotide
cuuccacaaacauguuaaugccuaagu

SEQ ID NO: 694 - RNA, 27 nt, Artificial Sequence
  Description of Artificial Sequence: Synthetic oligonucleotide
ucuuccacaaacauguuaaugccuaag

SEQ ID NO: 695 - RNA, 27 nt, Artificial Sequence
  Description of Artificial Sequence: Synthetic oligonucleotide
acucaaaugauacaauauacgucugcu

SEQ ID NO: 696 - RNA, 27 nt, Artificial Sequence
  Description of Artificial Sequence: Synthetic oligonucleotide
auucacucaaaugauacaauauacguc

SEQ ID NO: 697 - RNA, 27 nt, Artificial Sequence
  Description of Artificial Sequence: Synthetic oligonucleotide
acauucacucaaaugauacaauauacg

SEQ ID NO: 698 - RNA, 27 nt, Artificial Sequence
  Description of Artificial Sequence: Synthetic oligonucleotide
ggaacauucacucaaaugauacaauau

SEQ ID NO: 699 - RNA, 27 nt, Artificial Sequence
  Description of Artificial Sequence: Synthetic oligonucleotide
gggaacauucacucaaaugauacaaua

SEQ ID NO: 700 - RNA, 27 nt, Artificial Sequence
  Description of Artificial Sequence: Synthetic oligonucleotide
ugggaacauucacucaaaugauacaau

SEQ ID NO: 701 - RNA, 27 nt, Artificial Sequence
  Description of Artificial Sequence: Synthetic oligonucleotide
uauaaaaguuagguucuaaauuccuau

SEQ ID NO: 702 - RNA, 27 nt, Artificial Sequence
  Description of Artificial Sequence: Synthetic oligonucleotide
cuauaaaaguuagguucuaaauuccua

SEQ ID NO: 703 - RNA, 27 nt, Artificial Sequence
  Description of Artificial Sequence: Synthetic oligonucleotide
uaaccuauaaaaguuagguucuaaauu

SEQ ID NO: 704 - RNA, 27 nt, Artificial Sequence
  Description of Artificial Sequence: Synthetic oligonucleotide
auaaccuauaaaaguuagguucuaaau

SEQ ID NO: 705 - RNA, 27 nt, Artificial Sequence
  Description of Artificial Sequence: Synthetic oligonucleotide
gauaaccuauaaaaguuagguucuaaa

SEQ ID NO: 706 - RNA, 27 nt, Artificial Sequence
  Description of Artificial Sequence: Synthetic oligonucleotide
ugauaaccuauaaaaguuagguucuaa

SEQ ID NO: 707 - RNA, 27 nt, Artificial Sequence
  Description of Artificial Sequence: Synthetic oligonucleotide
ugacaacaguuuugauaaccuauaaaa

SEQ ID NO: 708 - RNA, 27 nt, Artificial Sequence
  Description of Artificial Sequence: Synthetic oligonucleotide
ggugacaacaguuuugauaaccuauaa

SEQ ID NO: 709 - RNA, 27 nt, Artificial Sequence
  Description of Artificial Sequence: Synthetic oligonucleotide
uuucuauguauauauuaggacaaaauu

SEQ ID NO: 710 - RNA, 27 nt, Artificial Sequence
  Description of Artificial Sequence: Synthetic oligonucleotide
guuucuauguauauauuaggacaaaau

SEQ ID NO: 711 - RNA, 27 nt, Artificial Sequence
  Description of Artificial Sequence: Synthetic oligonucleotide
aguuucuauguauauauuaggacaaaa

SEQ ID NO: 712 - RNA, 27 nt, Artificial Sequence
  Description of Artificial Sequence: Synthetic oligonucleotide
ccacaaaguuucuauguauauauuagg

SEQ ID NO: 713 - RNA, 27 nt, Artificial Sequence
  Description of Artificial Sequence: Synthetic oligonucleotide
augccccacaaaguuucuauguauaua

SEQ ID NO: 714 - RNA, 27 nt, Artificial Sequence
  Description of Artificial Sequence: Synthetic oligonucleotide
auggaauacaaaugagaugaacuugug

SEQ ID NO: 715 - RNA, 27 nt, Artificial Sequence
  Description of Artificial Sequence: Synthetic oligonucleotide
aaaaaaaaucaauggaauacaaaugag

SEQ ID NO: 716 - RNA, 27 nt, Artificial Sequence
  Description of Artificial Sequence: Synthetic oligonucleotide
aaaaaaaaaucaauggaauacaaauga

SEQ ID NO: 717 - RNA, 27 nt, Artificial Sequence
  Description of Artificial Sequence: Synthetic oligonucleotide
aaaaaaaaaaucaauggaauacaaaug

SEQ ID NO: 718 - RNA, 27 nt, Artificial Sequence
  Description of Artificial Sequence: Synthetic oligonucleotide
gaaaaaaaaaaucaauggaauacaaau

SEQ ID NO: 719 - RNA, 27 nt, Artificial Sequence
  Description of Artificial Sequence: Synthetic oligonucleotide
agaaaaaaaaaaucaauggaauacaaa

SEQ ID NO: 720 - RNA, 27 nt, Artificial Sequence
  Description of Artificial Sequence: Synthetic oligonucleotide
aagaaaaaaaaaaucaauggaauacaa

SEQ ID NO: 721 - RNA, 27 nt, Artificial Sequence
  Description of Artificial Sequence: Synthetic oligonucleotide
gaagaaaaaaaaaaucaauggaauaca

SEQ ID NO: 722 - RNA, 27 nt, Artificial Sequence
  Description of Artificial Sequence: Synthetic oligonucleotide
auguuuagaagaaaaaaaaaaucaaug

SEQ ID NO: 723 - RNA, 27 nt, Artificial Sequence
  Description of Artificial Sequence: Synthetic oligonucleotide
aauguuuagaagaaaaaaaaaaucaau

SEQ ID NO: 724 - RNA, 27 nt, Artificial Sequence
  Description of Artificial Sequence: Synthetic oligonucleotide
aaaaaauguuuagaagaaaaaaaaaau

SEQ ID NO: 725 - RNA, 27 nt, Artificial Sequence
  Description of Artificial Sequence: Synthetic oligonucleotide
gaaaaaauguuuagaagaaaaaaaaaa

SEQ ID NO: 726 - RNA, 27 nt, Artificial Sequence
  Description of Artificial Sequence: Synthetic oligonucleotide
agaaaaaauguuuagaagaaaaaaaaa

SEQ ID NO: 727 - RNA, 27 nt, Artificial Sequence
  Description of Artificial Sequence: Synthetic oligonucleotide
aagaaaaaauguuuagaagaaaaaaaa

SEQ ID NO: 728 - RNA, 27 nt, Artificial Sequence
  Description of Artificial Sequence: Synthetic oligonucleotide
gaagaaaaaauguuuagaagaaaaaaa

SEQ ID NO: 729 - RNA, 27 nt, Artificial Sequence
  Description of Artificial Sequence: Synthetic oligonucleotide
uuauauacuguuugaagaaaaaauguu

SEQ ID NO: 730 - RNA, 27 nt, Artificial Sequence
  Description of Artificial Sequence: Synthetic oligonucleotide
guuauauacuguuugaagaaaaaaugu

SEQ ID NO: 731 - RNA, 27 nt, Artificial Sequence
  Description of Artificial Sequence: Synthetic oligonucleotide
aguuauauacuguuugaagaaaaaaug

SEQ ID NO: 732 - RNA, 27 nt, Artificial Sequence
  Description of Artificial Sequence: Synthetic oligonucleotide
aaguuauauacuguuugaagaaaaaau

SEQ ID NO: 733 - RNA, 27 nt, Artificial Sequence
  Description of Artificial Sequence: Synthetic oligonucleotide
aaaguuauauacuguuugaagaaaaaa

SEQ ID NO: 734 - RNA, 27 nt, Artificial Sequence
  Description of Artificial Sequence: Synthetic oligonucleotide
ccuaaaaaaaguuauauacuguuugaa

SEQ ID NO: 735 - RNA, 27 nt, Artificial Sequence
  Description of Artificial Sequence: Synthetic oligonucleotide
aauccccuaaaaaaaguuauauacugu

SEQ ID NO: 736 - RNA, 27 nt, Artificial Sequence
  Description of Artificial Sequence: Synthetic oligonucleotide
aaauccccuaaaaaaaguuauauacug

SEQ ID NO: 737 - RNA, 27 nt, Artificial Sequence
  Description of Artificial Sequence: Synthetic oligonucleotide
aaaauccccuaaaaaaaguuauauacu

SEQ ID NO: 738 - RNA, 27 nt, Artificial Sequence
  Description of Artificial Sequence: Synthetic oligonucleotide
aaaaauccccuaaaaaaaguuauauac

SEQ ID NO: 739 - RNA, 27 nt, Artificial Sequence
  Description of Artificial Sequence: Synthetic oligonucleotide
cuaaaaaaaaauccccuaaaaaaaguu

SEQ ID NO: 740 - RNA, 27 nt, Artificial Sequence
  Description of Artificial Sequence: Synthetic oligonucleotide
ucuaaaaaaaaauccccuaaaaaaagu

SEQ ID NO: 741 - RNA, 27 nt, Artificial Sequence
  Description of Artificial Sequence: Synthetic oligonucleotide
aguuuuugcugucuaaaaaaaaauccc

SEQ ID NO: 742 - RNA, 27 nt, Artificial Sequence
  Description of Artificial Sequence: Synthetic oligonucleotide
uaguuuuugcugucuaaaaaaaaaucc

SEQ ID NO: 743 - RNA, 27 nt, Artificial Sequence
  Description of Artificial Sequence: Synthetic oligonucleotide
auaguuuuugcugucuaaaaaaaaauc

SEQ ID NO: 744 - RNA, 27 nt, Artificial Sequence
  Description of Artificial Sequence: Synthetic oligonucleotide
uuacuuuuugacaaauggaaaucuuca

SEQ ID NO: 745 - RNA, 27 nt, Artificial Sequence
  Description of Artificial Sequence: Synthetic oligonucleotide
auuacuuuuugacaaauggaaaucuuc

SEQ ID NO: 746 - RNA, 27 nt, Artificial Sequence
  Description of Artificial Sequence: Synthetic oligonucleotide
cauuacuuuuugacaaauggaaaucuu

SEQ ID NO: 747 - RNA, 27 nt, Artificial Sequence
  Description of Artificial Sequence: Synthetic oligonucleotide
ucauuacuuuuugacaaauggaaaucu

SEQ ID NO: 748 - RNA, 27 nt, Artificial Sequence
  Description of Artificial Sequence: Synthetic oligonucleotide
agaaaucauuacuuuuugacaaaugga

SEQ ID NO: 749 - RNA, 27 nt, Artificial Sequence
  Description of Artificial Sequence: Synthetic oligonucleotide
aagaaaucauuacuuuuugacaaaugg

SEQ ID NO: 750 - RNA, 27 nt, Artificial Sequence
  Description of Artificial Sequence: Synthetic oligonucleotide
caagaaaucauuacuuuuugacaaaug

SEQ ID NO: 751 - RNA, 27 nt, Artificial Sequence
  Description of Artificial Sequence: Synthetic oligonucleotide
auuaucaagaaaucauuacuuuuugac

SEQ ID NO: 752 - RNA, 27 nt, Artificial Sequence
  Description of Artificial Sequence: Synthetic oligonucleotide
aauuaucaagaaaucauuacuuuuuga

SEQ ID NO: 753 - RNA, 27 nt, Artificial Sequence
  Description of Artificial Sequence: Synthetic oligonucleotide
caauuaucaagaaaucauuacuuuuug

SEQ ID NO: 754 - RNA, 27 nt, Artificial Sequence
  Description of Artificial Sequence: Synthetic oligonucleotide
acaauuaucaagaaaucauuacuuuuu

SEQ ID NO: 755 - RNA, 27 nt, Artificial Sequence
  Description of Artificial Sequence: Synthetic oligonucleotide
acacaauuaucaagaaaucauuacuuu

SEQ ID NO: 756 - RNA, 27 nt, Artificial Sequence
  Description of Artificial Sequence: Synthetic oligonucleotide
cuacacaauuaucaagaaaucauuacu

SEQ ID NO: 757 - RNA, 27 nt, Artificial Sequence
  Description of Artificial Sequence: Synthetic oligonucleotide
acuacacaauuaucaagaaaucauuac

SEQ ID NO: 758 - RNA, 27 nt, Artificial Sequence
  Description of Artificial Sequence: Synthetic oligonucleotide
uuacuacacaauuaucaagaaaucauu

SEQ ID NO: 759 - RNA, 27 nt, Artificial Sequence
  Description of Artificial Sequence: Synthetic oligonucleotide
auuacuacacaauuaucaagaaaucau

SEQ ID NO: 760 - RNA, 27 nt, Artificial Sequence
  Description of Artificial Sequence: Synthetic oligonucleotide
aaaacauuacuacacaauuaucaagaa

SEQ ID NO: 761 - RNA, 27 nt, Artificial Sequence
  Description of Artificial Sequence: Synthetic oligonucleotide
aaaaacauuacuacacaauuaucaaga

SEQ ID NO: 762 - RNA, 27 nt, Artificial Sequence
  Description of Artificial Sequence: Synthetic oligonucleotide
aaaaaacauuacuacacaauuaucaag

SEQ ID NO: 763 - RNA, 27 nt, Artificial Sequence
  Description of Artificial Sequence: Synthetic oligonucleotide
cuaaaaaacauuacuacacaauuauca

SEQ ID NO: 764 - RNA, 27 nt, Artificial Sequence
  Description of Artificial Sequence: Synthetic oligonucleotide
guucuaaaaaacauuacuacacaauua

SEQ ID NO: 765 - RNA, 27 nt, Artificial Sequence
  Description of Artificial Sequence: Synthetic oligonucleotide
ggguucuaaaaaacauuacuacacaau

SEQ ID NO: 766 - RNA, 27 nt, Artificial Sequence
  Description of Artificial Sequence: Synthetic oligonucleotide
uggguucuaaaaaacauuacuacacaa

SEQ ID NO: 767 - RNA, 27 nt, Artificial Sequence
  Description of Artificial Sequence: Synthetic oligonucleotide
uuacuaaauauaaauucagcuuuaagg

SEQ ID NO: 768 - RNA, 27 nt, Artificial Sequence
  Description of Artificial Sequence: Synthetic oligonucleotide
aguuacuaaauauaaauucagcuuuaa

SEQ ID NO: 769 - RNA, 27 nt, Artificial Sequence
  Description of Artificial Sequence: Synthetic oligonucleotide
uaacacagaaguuacuaaauauaaauu

SEQ ID NO: 770 - RNA, 27 nt, Artificial Sequence
  Description of Artificial Sequence: Synthetic oligonucleotide
uuaacacagaaguuacuaaauauaaau

SEQ ID NO: 771 - RNA, 27 nt, Artificial Sequence
  Description of Artificial Sequence: Synthetic oligonucleotide
auuaacacagaaguuacuaaauauaaa

SEQ ID NO: 772 - RNA, 27 nt, Artificial Sequence
  Description of Artificial Sequence: Synthetic oligonucleotide
ccaguauuaacacagaaguuacuaaau

SEQ ID NO: 773 - RNA, 27 nt, Artificial Sequence
  Description of Artificial Sequence: Synthetic oligonucleotide
aguuucauuuuaugacagcuauucagu

SEQ ID NO: 774 - RNA, 27 nt, Artificial Sequence
  Description of Artificial Sequence: Synthetic oligonucleotide
aaguuucauuuuaugacagcuauucag

SEQ ID NO: 775 - RNA, 27 nt, Artificial Sequence
  Description of Artificial Sequence: Synthetic oligonucleotide
uuucuuuagaaagaaaguuucauuuua

SEQ ID NO: 776 - RNA, 27 nt, Artificial Sequence
  Description of Artificial Sequence: Synthetic oligonucleotide
cuuucuuuagaaagaaaguuucauuuu

SEQ ID NO: 777 - RNA, 27 nt, Artificial Sequence
  Description of Artificial Sequence: Synthetic oligonucleotide
ucuuucuuuagaaagaaaguuucauuu

SEQ ID NO: 778 - RNA, 27 nt, Artificial Sequence
  Description of Artificial Sequence: Synthetic oligonucleotide
uaucuuucuuuagaaagaaaguuucau

SEQ ID NO: 779 - RNA, 27 nt, Artificial Sequence
  Description of Artificial Sequence: Synthetic oligonucleotide
ugaguaucuuucuuuagaaagaaaguu

SEQ ID NO: 780 - RNA, 27 nt, Artificial Sequence
  Description of Artificial Sequence: Synthetic oligonucleotide
uaugacuauucuucaagaacucaugug

SEQ ID NO: 781 - RNA, 27 nt, Artificial Sequence
  Description of Artificial Sequence: Synthetic oligonucleotide
uaaucuaguuaugacuauucuucaaga

SEQ ID NO: 782 - RNA, 27 nt, Artificial Sequence
  Description of Artificial Sequence: Synthetic oligonucleotide
uuaaucuaguuaugacuauucuucaag

SEQ ID NO: 783 - RNA, 27 nt, Artificial Sequence
  Description of Artificial Sequence: Synthetic oligonucleotide
cuuaaucuaguuaugacuauucuucaa

SEQ ID NO: 784 - RNA, 27 nt, Artificial Sequence
  Description of Artificial Sequence: Synthetic oligonucleotide
gaucuuaaucuaguuaugacuauucuu

SEQ ID NO: 785 - RNA, 27 nt, Artificial Sequence
  Description of Artificial Sequence: Synthetic oligonucleotide
agaucuuaaucuaguuaugacuauucu

SEQ ID NO: 786 - RNA, 27 nt, Artificial Sequence
  Description of Artificial Sequence: Synthetic oligonucleotide
cagaucuuaaucuaguuaugacuauuc

SEQ ID NO: 787 - RNA, 27 nt, Artificial Sequence
  Description of Artificial Sequence: Synthetic oligonucleotide
acagaucuuaaucuaguuaugacuauu

SEQ ID NO: 788 - RNA, 27 nt, Artificial Sequence
  Description of Artificial Sequence: Synthetic oligonucleotide
aaacacagaucuuaaucuaguuaugac

SEQ ID NO: 789 - RNA, 27 nt, Artificial Sequence
  Description of Artificial Sequence: Synthetic oligonucleotide
aaacuaaaacacagaucuuaaucuagu

SEQ ID NO: 790 - RNA, 27 nt, Artificial Sequence
  Description of Artificial Sequence: Synthetic oligonucleotide
uuaaacuaaaacacagaucuuaaucua

SEQ ID NO: 791 - RNA, 27 nt, Artificial Sequence
  Description of Artificial Sequence: Synthetic oligonucleotide
auuaaacuaaaacacagaucuuaaucu

SEQ ID NO: 792 - RNA, 27 nt, Artificial Sequence
  Description of Artificial Sequence: Synthetic oligonucleotide
cuauuaaacuaaaacacagaucuuaau

SEQ ID NO: 793 - RNA, 27 nt, Artificial Sequence
  Description of Artificial Sequence: Synthetic oligonucleotide
cuucaaacuauuaaacuaaaacacaga

SEQ ID NO: 794 - RNA, 27 nt, Artificial Sequence
  Description of Artificial Sequence: Synthetic oligonucleotide
acuucaaacuauuaaacuaaaacacag

SEQ ID NO: 795 - RNA, 27 nt, Artificial Sequence
  Description of Artificial Sequence: Synthetic oligonucleotide
gcacuucaaacuauuaaacuaaaacac

SEQ ID NO: 796 - RNA, 27 nt, Artificial Sequence
  Description of Artificial Sequence: Synthetic oligonucleotide
aggcacuucaaacuauuaaacuaaaac

SEQ ID NO: 797 - RNA, 27 nt, Artificial Sequence
  Description of Artificial Sequence: Synthetic oligonucleotide
caggcacuucaaacuauuaaacuaaaa

SEQ ID NO: 798 - RNA, 27 nt, Artificial Sequence
  Description of Artificial Sequence: Synthetic oligonucleotide
ucuaaauuaccuaucauuaucccaaac

SEQ ID NO: 799 - RNA, 27 nt, Artificial Sequence
  Description of Artificial Sequence: Synthetic oligonucleotide
caucuaaauuaccuaucauuaucccaa

SEQ ID NO: 800 - RNA, 27 nt, Artificial Sequence
  Description of Artificial Sequence: Synthetic oligonucleotide
auucaucuaaauuaccuaucauuaucc

SEQ ID NO: 801 - RNA, 27 nt, Artificial Sequence
  Description of Artificial Sequence: Synthetic oligonucleotide
aauucaucuaaauuaccuaucauuauc

SEQ ID NO: 802 - RNA, 27 nt, Artificial Sequence
  Description of Artificial Sequence: Synthetic oligonucleotide
cuaaauucaucuaaauuaccuaucauu

SEQ ID NO: 803 - RNA, 27 nt, Artificial Sequence
  Description of Artificial Sequence: Synthetic oligonucleotide
ccuaaauucaucuaaauuaccuaucau

SEQ ID NO: 804 - RNA, 27 nt, Artificial Sequence
  Description of Artificial Sequence: Synthetic oligonucleotide
uuuccccuaaauucaucuaaauuaccu

SEQ ID NO: 805 - RNA, 27 nt, Artificial Sequence
  Description of Artificial Sequence: Synthetic oligonucleotide
uuuuuccccuaaauucaucuaaauuac

SEQ ID NO: 806 - RNA, 27 nt, Artificial Sequence
  Description of Artificial Sequence: Synthetic oligonucleotide
uaacuuuuuuuuccccuaaauucaucu

SEQ ID NO: 807 - RNA, 27 nt, Artificial Sequence
  Description of Artificial Sequence: Synthetic oligonucleotide
auaacuuuuuuuuccccuaaauucauc

SEQ ID NO: 808 - RNA, 27 nt, Artificial Sequence
  Description of Artificial Sequence: Synthetic oligonucleotide
cauaucugcagauaacuuuuuuuuccc

SEQ ID NO: 809 - RNA, 27 nt, Artificial Sequence
  Description of Artificial Sequence: Synthetic oligonucleotide
acauaucugcagauaacuuuuuuuucc

SEQ ID NO: 810 - RNA, 27 nt, Artificial Sequence
  Description of Artificial Sequence: Synthetic oligonucleotide
ccucaacauaucugcagauaacuuuuu

SEQ ID NO: 811 - RNA, 27 nt, Artificial Sequence
  Description of Artificial Sequence: Synthetic oligonucleotide
aguauuuucaacaugaaaacacaagac

SEQ ID NO: 812 - RNA, 27 nt, Artificial Sequence
  Description of Artificial Sequence: Synthetic oligonucleotide
aaguauuuucaacaugaaaacacaaga

SEQ ID NO: 813 - RNA, 27 nt, Artificial Sequence
  Description of Artificial Sequence: Synthetic oligonucleotide
aaaguauuuucaacaugaaaacacaag

SEQ ID NO: 814 - RNA, 27 nt, Artificial Sequence
  Description of Artificial Sequence: Synthetic oligonucleotide
gaaaaaugcaaaaguauuuucaacaug

SEQ ID NO: 815 - RNA, 27 nt, Artificial Sequence
  Description of Artificial Sequence: Synthetic oligonucleotide
ggaaaaaugcaaaaguauuuucaacau

SEQ ID NO: 816 - RNA, 27 nt, Artificial Sequence
  Description of Artificial Sequence: Synthetic oligonucleotide
aggaaaaaugcaaaaguauuuucaaca

SEQ ID NO: 817 - RNA, 27 nt, Artificial Sequence
  Description of Artificial Sequence: Synthetic oligonucleotide
aaggaaaaaugcaaaaguauuuucaac

SEQ ID NO: 818 - RNA, 27 nt, Artificial Sequence
  Description of Artificial Sequence: Synthetic oligonucleotide
uuggcacucaaaggaaaaaugcaaaag

SEQ ID NO: 819 - RNA, 27 nt, Artificial Sequence
  Description of Artificial Sequence: Synthetic oligonucleotide
auaguacuaguaagaaauuggcacuca

SEQ ID NO: 820 - RNA, 27 nt, Artificial Sequence
  Description of Artificial Sequence: Synthetic oligonucleotide
aagaaauaguacuaguaagaaauuggc

SEQ ID NO: 821 - RNA, 27 nt, Artificial Sequence
  Description of Artificial Sequence: Synthetic oligonucleotide
uaagaaauaguacuaguaagaaauugg

SEQ ID NO: 822 - RNA, 27 nt, Artificial Sequence
  Description of Artificial Sequence: Synthetic oligonucleotide
auguuacauuaagaaauaguacuagua

SEQ ID NO: 823 - RNA, 27 nt, Artificial Sequence
  Description of Artificial Sequence: Synthetic oligonucleotide
cauguuacauuaagaaauaguacuagu

SEQ ID NO: 824 - RNA, 27 nt, Artificial Sequence
  Description of Artificial Sequence: Synthetic oligonucleotide
guaaacauguuacauuaagaaauagua

SEQ ID NO: 825 - RNA, 27 nt, Artificial Sequence
  Description of Artificial Sequence: Synthetic oligonucleotide
gguaaacauguuacauuaagaaauagu

SEQ ID NO: 826 - RNA, 27 nt, Artificial Sequence
  Description of Artificial Sequence: Synthetic oligonucleotide
agguaaacauguuacauuaagaaauag

SEQ ID NO: 827 - RNA, 27 nt, Artificial Sequence
  Description of Artificial Sequence: Synthetic oligonucleotide
acauuccagguaaacauguuacauuaa

SEQ ID NO: 828 - RNA, 27 nt, Artificial Sequence
  Description of Artificial Sequence: Synthetic oligonucleotide
acaaaaauaguuaaaauacauuccagg

SEQ ID NO: 829 - RNA, 27 nt, Artificial Sequence
  Description of Artificial Sequence: Synthetic oligonucleotide
auacaaaaauaguuaaaauacauucca

SEQ ID NO: 830 - RNA, 27 nt, Artificial Sequence
  Description of Artificial Sequence: Synthetic oligonucleotide
uauacaaaaauaguuaaaauacauucc

SEQ ID NO: 831 - RNA, 27 nt, Artificial Sequence
  Description of Artificial Sequence: Synthetic oligonucleotide
cuauacaaaaauaguuaaaauacauuc

SEQ ID NO: 832 - RNA, 27 nt, Artificial Sequence
  Description of Artificial Sequence: Synthetic oligonucleotide
acuauacaaaaauaguuaaaauacauu

SEQ ID NO: 833 - RNA, 27 nt, Artificial Sequence
  Description of Artificial Sequence: Synthetic oligonucleotide
acacuauacaaaaauaguuaaaauaca

SEQ ID NO: 834 - RNA, 27 nt, Artificial Sequence
  Description of Artificial Sequence: Synthetic oligonucleotide
uuacacuauacaaaaauaguuaaaaua

SEQ ID NO: 835 - RNA, 27 nt, Artificial Sequence
  Description of Artificial Sequence: Synthetic oligonucleotide
uuuacacuauacaaaaauaguuaaaau

SEQ ID NO: 836 - RNA, 27 nt, Artificial Sequence
  Description of Artificial Sequence: Synthetic oligonucleotide
guuuacacuauacaaaaauaguuaaaa

SEQ ID NO: 837 - RNA, 27 nt, Artificial Sequence
  Description of Artificial Sequence: Synthetic oligonucleotide
uguuucaguuuacacuauacaaaaaua

SEQ ID NO: 838 - RNA, 27 nt, Artificial Sequence
  Description of Artificial Sequence: Synthetic oligonucleotide
auguuucaguuuacacuauacaaaaau

SEQ ID NO: 839 - RNA, 27 nt, Artificial Sequence
  Description of Artificial Sequence: Synthetic oligonucleotide
cauguuucaguuuacacuauacaaaaa

SEQ ID NO: 840 - RNA, 27 nt, Artificial Sequence
  Description of Artificial Sequence: Synthetic oligonucleotide
aauguacaaaaugugcauguuucaguu

SEQ ID NO: 841 - RNA, 27 nt, Artificial Sequence
  Description of Artificial Sequence: Synthetic oligonucleotide
aagcacaauguacaaaaugugcauguu

SEQ ID NO: 842 - RNA, 27 nt, Artificial Sequence
  Description of Artificial Sequence: Synthetic oligonucleotide
gcaaccaaaugauggaaaacaacugga

SEQ ID NO: 843 - RNA, 27 nt, Artificial Sequence
  Description of Artificial Sequence: Synthetic oligonucleotide
gcgcaaccaaaugauggaaaacaacug

SEQ ID NO: 844 - RNA, 27 nt, Artificial Sequence
  Description of Artificial Sequence: Synthetic oligonucleotide
auuuuuaauguuugauaugaccaacau

SEQ ID NO: 845 - RNA, 27 nt, Artificial Sequence
  Description of Artificial Sequence: Synthetic oligonucleotide
cauuuuuaauguuugauaugaccaaca

SEQ ID NO: 846 - RNA, 27 nt, Artificial Sequence
  Description of Artificial Sequence: Synthetic oligonucleotide
ucauuuuuaauguuugauaugaccaac

SEQ ID NO: 847 - RNA, 27 nt, Artificial Sequence
  Description of Artificial Sequence: Synthetic oligonucleotide
guggucauuuuuaauguuugauaugac

SEQ ID NO: 848 - RNA, 27 nt, Artificial Sequence
  Description of Artificial Sequence: Synthetic oligonucleotide
aauuucaauuaaaagaguggucauuuu

SEQ ID NO: 849 - RNA, 27 nt, Artificial Sequence
  Description of Artificial Sequence: Synthetic oligonucleotide
uaauuucaauuaaaagaguggucauuu

SEQ ID NO: 850 - RNA, 27 nt, Artificial Sequence
  Description of Artificial Sequence: Synthetic oligonucleotide
uuuaaaaguuaauuucaauuaaaagag

SEQ ID NO: 851 - RNA, 27 nt, Artificial Sequence
  Description of Artificial Sequence: Synthetic oligonucleotide
auuuaaaaguuaauuucaauuaaaaga

SEQ ID NO: 852 - RNA, 27 nt, Artificial Sequence
  Description of Artificial Sequence: Synthetic oligonucleotide
acauuuaaaaguuaauuucaauuaaaa

SEQ ID NO: 853 - RNA, 27 nt, Artificial Sequence
  Description of Artificial Sequence: Synthetic oligonucleotide
aaacauuuaaaaguuaauuucaauuaa

SEQ ID NO: 854 - RNA, 27 nt, Artificial Sequence
  Description of Artificial Sequence: Synthetic oligonucleotide
uaaacauuuaaaaguuaauuucaauua

SEQ ID NO: 855 - RNA, 27 nt, Artificial Sequence
  Description of Artificial Sequence: Synthetic oligonucleotide
auaaacauuuaaaaguuaauuucaauu

SEQ ID NO: 856 - RNA, 27 nt, Artificial Sequence
  Description of Artificial Sequence: Synthetic oligonucleotide
uauaaacauuuaaaaguuaauuucaau

SEQ ID NO: 857 - RNA, 27 nt, Artificial Sequence
  Description of Artificial Sequence: Synthetic oligonucleotide
cuauaaacauuuaaaaguuaauuucaa

SEQ ID NO: 858 - RNA, 27 nt, Artificial Sequence
  Description of Artificial Sequence: Synthetic oligonucleotide
ccuauaaacauuuaaaaguuaauuuca

SEQ ID NO: 859 - RNA, 27 nt, Artificial Sequence
  Description of Artificial Sequence: Synthetic oligonucleotide
acuccuauaaacauuuaaaaguuaauu

SEQ ID NO: 860 - RNA, 27 nt, Artificial Sequence
  Description of Artificial Sequence: Synthetic oligonucleotide
acauacuccuauaaacauuuaaaaguu

SEQ ID NO: 861 - RNA, 27 nt, Artificial Sequence
  Description of Artificial Sequence: Synthetic oligonucleotide
cagcacauacuccuauaaacauuuaaa

SEQ ID NO: 862 - RNA, 27 nt, Artificial Sequence
  Description of Artificial Sequence: Synthetic oligonucleotide
acagcacauacuccuauaaacauuuaa

SEQ ID NO: 863 - RNA, 27 nt, Artificial Sequence
  Description of Artificial Sequence: Synthetic oligonucleotide
auuacaaauuuuagaucacuucacagc

SEQ ID NO: 864 - RNA, 27 nt, Artificial Sequence
  Description of Artificial Sequence: Synthetic oligonucleotide
auauuacaaauuuuagaucacuucaca

SEQ ID NO: 865 - RNA, 27 nt, Artificial Sequence
  Description of Artificial Sequence: Synthetic oligonucleotide
aauauuacaaauuuuagaucacuucac

SEQ ID NO: 866 - RNA, 27 nt, Artificial Sequence
  Description of Artificial Sequence: Synthetic oligonucleotide
aaauauuacaaauuuuagaucacuuca

SEQ ID NO: 867 - RNA, 27 nt, Artificial Sequence
  Description of Artificial Sequence: Synthetic oligonucleotide
aaaauauuacaaauuuuagaucacuuc

SEQ ID NO: 868 - RNA, 27 nt, Artificial Sequence
  Description of Artificial Sequence: Synthetic oligonucleotide
aaaaauauuacaaauuuuagaucacuu

SEQ ID NO: 869 - RNA, 27 nt, Artificial Sequence
  Description of Artificial Sequence: Synthetic oligonucleotide
caaaaauauuacaaauuuuagaucacu

SEQ ID NO: 870 - RNA, 27 nt, Artificial Sequence
  Description of Artificial Sequence: Synthetic oligonucleotide
augacaaaaauauuacaaauuuuagau

SEQ ID NO: 871 - RNA, 27 nt, Artificial Sequence
  Description of Artificial Sequence: Synthetic oligonucleotide
caugacaaaaauauuacaaauuuuaga

SEQ ID NO: 872 - RNA, 27 nt, Artificial Sequence
  Description of Artificial Sequence: Synthetic oligonucleotide
aguucaugacaaaaauauuacaaauuu

SEQ ID NO: 873 - RNA, 27 nt, Artificial Sequence
  Description of Artificial Sequence: Synthetic oligonucleotide
caguucaugacaaaaauauuacaaauu

SEQ ID NO: 874 - RNA, 27 nt, Artificial Sequence
  Description of Artificial Sequence: Synthetic oligonucleotide
acaguucaugacaaaaauauuacaaau

SEQ ID NO: 875 - RNA, 27 nt, Artificial Sequence
  Description of Artificial Sequence: Synthetic oligonucleotide
uaguacaguucaugacaaaaauauuac

SEQ ID NO: 876 - RNA, 27 nt, Artificial Sequence
  Description of Artificial Sequence: Synthetic oligonucleotide
guaguacaguucaugacaaaaauauua

SEQ ID NO: 877 - RNA, 27 nt, Artificial Sequence
  Description of Artificial Sequence: Synthetic oligonucleotide
auuacaauaauuaggaguaguacaguu

SEQ ID NO: 878 - RNA, 27 nt, Artificial Sequence
  Description of Artificial Sequence: Synthetic oligonucleotide
cauuacaauaauuaggaguaguacagu

SEQ ID NO: 879 - RNA, 27 nt, Artificial Sequence
  Description of Artificial Sequence: Synthetic oligonucleotide
auuuuuauuacauuacaauaauuagga

SEQ ID NO: 880 - RNA, 27 nt, Artificial Sequence
  Description of Artificial Sequence: Synthetic oligonucleotide
uauuuuuauuacauuacaauaauuagg

SEQ ID NO: 881 - RNA, 27 nt, Artificial Sequence
  Description of Artificial Sequence: Synthetic oligonucleotide
acuauuuuuauuacauuacaauaauua

SEQ ID NO: 882 - RNA, 27 nt, Artificial Sequence
  Description of Artificial Sequence: Synthetic oligonucleotide
uaacuauuuuuauuacauuacaauaau

SEQ ID NO: 883 - RNA, 27 nt, Artificial Sequence
  Description of Artificial Sequence: Synthetic oligonucleotide
guaacuauuuuuauuacauuacaauaa

SEQ ID NO: 884 - RNA, 27 nt, Artificial Sequence
  Description of Artificial Sequence: Synthetic oligonucleotide
cuguaacuauuuuuauuacauuacaau

SEQ ID NO: 885 - RNA, 27 nt, Artificial Sequence
  Description of Artificial Sequence: Synthetic oligonucleotide
acuguaacuauuuuuauuacauuacaa

SEQ ID NO: 886 - RNA, 27 nt, Artificial Sequence
  Description of Artificial Sequence: Synthetic oligonucleotide
ugucacuguaacuauuuuuauuacauu

SEQ ID NO: 887 - RNA, 27 nt, Artificial Sequence
  Description of Artificial Sequence: Synthetic oligonucleotide
uugucacuguaacuauuuuuauuacau

SEQ ID NO: 888 - RNA, 27 nt, Artificial Sequence
  Description of Artificial Sequence: Synthetic oligonucleotide
uuugucacuguaacuauuuuuauuaca

SEQ ID NO: 889 - RNA, 27 nt, Artificial Sequence
  Description of Artificial Sequence: Synthetic oligonucleotide
uuuuuuuuuuugucacuguaacuauuu

SEQ ID NO: 890 - RNA, 27 nt, Artificial Sequence
  Description of Artificial Sequence: Synthetic oligonucleotide
uuuuuuuuuuuugucacuguaacuauu

SEQ ID NO: 891 - RNA, 27 nt, Artificial Sequence
  Description of Artificial Sequence: Synthetic oligonucleotide
uuuuuuuuuuuuuugucacuguaacua

SEQ ID NO: 892 - DNA, 25 bp, Artificial Sequence
  Description of Artificial Sequence: Synthetic oligonucleotide
  Description of Combined DNA/RNA Molecule: Synthetic oligonucleotide
cugaaaaugacugaauauaaacutg

SEQ ID NO: 893 - RNA, 25 nt, Artificial Sequence
  Description of Artificial Sequence: Synthetic oligonucleotide
augacugaauauaaacuugugguag

SEQ ID NO: 894 - RNA, 25 nt, Artificial Sequence
  Description of Artificial Sequence: Synthetic oligonucleotide
cugaauauaaacuugugguaguugg

SEQ ID NO: 895 - RNA, 25 nt, Artificial Sequence
  Description of Artificial Sequence: Synthetic oligonucleotide
cuaauucagaaucauuuuguggacg

SEQ ID NO: 896 - DNA, 25 bp, Artificial Sequence
  Description of Artificial Sequence: Synthetic oligonucleotide
  Description of Combined DNA/RNA Molecule: Synthetic oligonucleotide
gaauaugauccaacaauagaggatt

SEQ ID NO: 897 - DNA, 25 bp, Artificial Sequence
  Description of Artificial Sequence: Synthetic oligonucleotide
  Description of Combined DNA/RNA Molecule: Synthetic oligonucleotide
caaguaguaauugauggagaaacct

SEQ ID NO: 898 - DNA, 25 bp, Artificial Sequence
  Description of Artificial Sequence: Synthetic oligonucleotide
  Description of Combined DNA/RNA Molecule: Synthetic oligonucleotide
agggcuuucuuuguguauuugccat

SEQ ID NO: 899 - RNA, 25 nt, Artificial Sequence
  Description of Artificial Sequence: Synthetic oligonucleotide
uuuguguauuugccauaaauaauac

SEQ ID NO: 900 - DNA, 25 bp, Artificial Sequence
  Description of Artificial Sequence: Synthetic oligonucleotide
  Description of Combined DNA/RNA Molecule: Synthetic oligonucleotide
uuguguauuugccauaaauaauact

SEQ ID NO: 901 - DNA, 25 bp, Artificial Sequence
  Description of Artificial Sequence: Synthetic oligonucleotide
  Description of Combined DNA/RNA Molecule: Synthetic oligonucleotide
uguguauuugccauaaauaauacta

SEQ ID NO: 902 - RNA, 25 nt, Artificial Sequence
  Description of Artificial Sequence: Synthetic oligonucleotide
guguauuugccauaaauaauacuaa

SEQ ID NO: 903 - RNA, 25 nt, Artificial Sequence
  Description of Artificial Sequence: Synthetic oligonucleotide
auuugccauaaauaauacuaaauca

SEQ ID NO: 904 - DNA, 25 bp, Artificial Sequence
  Description of Artificial Sequence: Synthetic oligonucleotide
  Description of Combined DNA/RNA Molecule: Synthetic oligonucleotide
uuugccauaaauaauacuaaaucat

SEQ ID NO: 905 - RNA, 25 nt, Artificial Sequence
  Description of Artificial Sequence: Synthetic oligonucleotide
auaaauaauacuaaaucauuugaag

SEQ ID NO: 906 - RNA, 25 nt, Artificial Sequence
  Description of Artificial Sequence: Synthetic oligonucleotide
uaaauaauacuaaaucauuugaaga

SEQ ID NO: 907 - DNA, 25 bp, Artificial Sequence
  Description of Artificial Sequence: Synthetic oligonucleotide
  Description of Combined DNA/RNA Molecule: Synthetic oligonucleotide
aauaauacuaaaucauuugaagata

SEQ ID NO: 908 - DNA, 25 bp, Artificial Sequence
  Description of Artificial Sequence: Synthetic oligonucleotide
  Description of Combined DNA/RNA Molecule: Synthetic oligonucleotide
auaauacuaaaucauuugaagauat

SEQ ID NO: 909 - DNA, 25 bp, Artificial Sequence
  Description of Artificial Sequence: Synthetic oligonucleotide
  Description of Combined DNA/RNA Molecule: Synthetic oligonucleotide
uaauacuaaaucauuugaagauatt

SEQ ID NO: 910 - DNA, 25 bp, Artificial Sequence
  Description of Artificial Sequence: Synthetic oligonucleotide
  Description of Combined DNA/RNA Molecule: Synthetic oligonucleotide
aauacuaaaucauuugaagauautc

SEQ ID NO: 911 - RNA, 25 nt, Artificial Sequence
  Description of Artificial Sequence: Synthetic oligonucleotide
uugaagauauucaccauuauagaga

SEQ ID NO: 912 - RNA, 25 nt, Artificial Sequence
  Description of Artificial Sequence: Synthetic oligonucleotide
gaagauauucaccauuauagagaac

SEQ ID NO: 913 - RNA, 25 nt, Artificial Sequence
  Description of Artificial Sequence: Synthetic oligonucleotide
aagauauucaccauuauagagaaca

SEQ ID NO: 914 - RNA, 25 nt, Artificial Sequence
  Description of Artificial Sequence: Synthetic oligonucleotide
agauauucaccauuauagagaacaa

SEQ ID NO: 915 - RNA, 25 nt, Artificial Sequence
  Description of Artificial Sequence: Synthetic oligonucleotide
gauauucaccauuauagagaacaaa

SEQ ID NO: 916 - DNA, 25 bp, Artificial Sequence
  Description of Artificial Sequence: Synthetic oligonucleotide
  Description of Combined DNA/RNA Molecule: Synthetic oligonucleotide
auuauagagaacaaauuaaaagagt

SEQ ID NO: 917 - DNA, 25 bp, Artificial Sequence
  Description of Artificial Sequence: Synthetic oligonucleotide
  Description of Combined DNA/RNA Molecule: Synthetic oligonucleotide
uauagagaacaaauuaaaagaguta

SEQ ID NO: 918 - RNA, 25 nt, Artificial Sequence
  Description of Artificial Sequence: Synthetic oligonucleotide
auagagaacaaauuaaaagaguuaa

SEQ ID NO: 919 - RNA, 25 nt, Artificial Sequence
  Description of Artificial Sequence: Synthetic oligonucleotide
uagagaacaaauuaaaagaguuaag

SEQ ID NO: 920 - RNA, 25 nt, Artificial Sequence
  Description of Artificial Sequence: Synthetic oligonucleotide
agagaacaaauuaaaagaguuaagg

SEQ ID NO: 921 - DNA, 25 bp, Artificial Sequence
  Description of Artificial Sequence: Synthetic oligonucleotide
  Description of Combined DNA/RNA Molecule: Synthetic oligonucleotide
aguaggaaauaaaugugauuugcct

SEQ ID NO: 922 - DNA, 25 bp, Artificial Sequence
  Description of Artificial Sequence: Synthetic oligonucleotide
  Description of Combined DNA/RNA Molecule: Synthetic oligonucleotide
guaggaaauaaaugugauuugcctt

SEQ ID NO: 923 - RNA, 25 nt, Artificial Sequence
  Description of Artificial Sequence: Synthetic oligonucleotide
gaaguuauggaauuccuuuuauuga

SEQ ID NO: 924 - RNA, 25 nt, Artificial Sequence
  Description of Artificial Sequence: Synthetic oligonucleotide
guuauggaauuccuuuuauugaaac

SEQ ID NO: 925 - RNA, 25 nt, Artificial Sequence
  Description of Artificial Sequence: Synthetic oligonucleotide
uuauggaauuccuuuuauugaaaca

SEQ ID NO: 926 - DNA, 25 bp, Artificial Sequence
  Description of Artificial Sequence: Synthetic oligonucleotide
  Description of Combined DNA/RNA Molecule: Synthetic oligonucleotide
uauggaauuccuuuuauugaaacat

SEQ ID NO: 927 - DNA, 25 bp, Artificial Sequence
  Description of Artificial Sequence: Synthetic oligonucleotide
  Description of Combined DNA/RNA Molecule: Synthetic oligonucleotide
auggaauuccuuuuauugaaacatc

SEQ ID NO: 928 - RNA, 25 nt, Artificial Sequence
  Description of Artificial Sequence: Synthetic oligonucleotide
gaggaugcuuuuuauacauugguga

SEQ ID NO: 929 - RNA, 25 nt, Artificial Sequence
  Description of Artificial Sequence: Synthetic oligonucleotide
ggaugcuuuuuauacauuggugagg

SEQ ID NO: 930 - RNA, 25 nt, Artificial Sequence
  Description of Artificial Sequence: Synthetic oligonucleotide
agauugaaaaaaaucagcaaagaag

SEQ ID NO: 931 - RNA, 25 nt, Artificial Sequence
  Description of Artificial Sequence: Synthetic oligonucleotide
gauugaaaaaaaucagcaaagaaga

SEQ ID NO: 932 - RNA, 25 nt, Artificial Sequence
  Description of Artificial Sequence: Synthetic oligonucleotide
uugaaaaaaaucagcaaagaagaaa

SEQ ID NO: 933 - RNA, 25 nt, Artificial Sequence
  Description of Artificial Sequence: Synthetic oligonucleotide
ugaaaaaaaucagcaaagaagaaaa

SEQ ID NO: 934 - RNA, 25 nt, Artificial Sequence
  Description of Artificial Sequence: Synthetic oligonucleotide
gaaaaaaaucagcaaagaagaaaag

SEQ ID NO: 935 - RNA, 25 nt, Artificial Sequence
  Description of Artificial Sequence: Synthetic oligonucleotide
aaaaaaaucagcaaagaagaaaaga

SEQ ID NO: 936 - DNA, 25 bp, Artificial Sequence
  Description of Artificial Sequence: Synthetic oligonucleotide
  Description of Combined DNA/RNA Molecule: Synthetic oligonucleotide
cuggcugugugaaaauuaaaaaatg

SEQ ID NO: 937 - DNA, 25 bp, Artificial Sequence
  Description of Artificial Sequence: Synthetic oligonucleotide
  Description of Combined DNA/RNA Molecule: Synthetic oligonucleotide
cugugugaaaauuaaaaaaugcatt

SEQ ID NO: 938 - RNA, 25 nt, Artificial Sequence
  Description of Artificial Sequence: Synthetic oligonucleotide
gugaaaauuaaaaaaugcauuauaa

SEQ ID NO: 939 - DNA, 25 bp, Artificial Sequence
  Description of Artificial Sequence: Synthetic oligonucleotide
  Description of Combined DNA/RNA Molecule: Synthetic oligonucleotide
ugaaaauuaaaaaaugcauuauaat

SEQ ID NO: 940 - DNA, 25 bp, Artificial Sequence
  Description of Artificial Sequence: Synthetic oligonucleotide
  Description of Combined DNA/RNA Molecule: Synthetic oligonucleotide
gaaaauuaaaaaaugcauuauaatg

SEQ ID NO: 941 - DNA, 25 bp, Artificial Sequence
  Description of Artificial Sequence: Synthetic oligonucleotide
  Description of Combined DNA/RNA Molecule: Synthetic oligonucleotide
aaaauuaaaaaaugcauuauaaugt

SEQ ID NO: 942 - RNA, 25 nt, Artificial Sequence
  Description of Artificial Sequence: Synthetic oligonucleotide
aauuaaaaaaugcauuauaauguaa

SEQ ID NO: 943 - DNA, 25 bp, Artificial Sequence
  Description of Artificial Sequence: Synthetic oligonucleotide
  Description of Combined DNA/RNA Molecule: Synthetic oligonucleotide
auuaaaaaaugcauuauaauguaat

SEQ ID NO: 944 - DNA, 25 bp, Artificial Sequence
  Description of Artificial Sequence: Synthetic oligonucleotide
  Description of Combined DNA/RNA Molecule: Synthetic oligonucleotide
uuaaaaaaugcauuauaauguaatc

SEQ ID NO: 945 - DNA, 25 bp, Artificial Sequence
  Description of Artificial Sequence: Synthetic oligonucleotide
  Description of Combined DNA/RNA Molecule: Synthetic oligonucleotide
uaaaaaaugcauuauaauguaauct

SEQ ID NO: 946 - RNA, 25 nt, Artificial Sequence
  Description of Artificial Sequence: Synthetic oligonucleotide
aaaaaugcauuauaauguaaucugg

SEQ ID NO: 947 - RNA, 25 nt, Artificial Sequence
  Description of Artificial Sequence: Synthetic oligonucleotide
cauuauaauguaaucuggguguuga

SEQ ID NO: 948 - RNA, 25 nt, Artificial Sequence
  Description of Artificial Sequence: Synthetic oligonucleotide
cgagaaauucgaaaacauaaagaaa

SEQ ID NO: 949 - RNA, 25 nt, Artificial Sequence
  Description of Artificial Sequence: Synthetic oligonucleotide
gagaaauucgaaaacauaaagaaaa

SEQ ID NO: 950 - RNA, 25 nt, Artificial Sequence
  Description of Artificial Sequence: Synthetic oligonucleotide
agaaauucgaaaacauaaagaaaag

SEQ ID NO: 951 - DNA, 25 bp, Artificial Sequence
  Description of Artificial Sequence: Synthetic oligonucleotide
  Description of Combined DNA/RNA Molecule: Synthetic oligonucleotide
aauucgaaaacauaaagaaaagatg

SEQ ID NO: 952 - RNA, 25 nt, Artificial Sequence
  Description of Artificial Sequence: Synthetic oligonucleotide
gaaaacauaaagaaaagaugagcaa

SEQ ID NO: 953 - RNA, 25 nt, Artificial Sequence
  Description of Artificial Sequence: Synthetic oligonucleotide
aaaacauaaagaaaagaugagcaaa

SEQ ID NO: 954 - RNA, 25 nt, Artificial Sequence
  Description of Artificial Sequence: Synthetic oligonucleotide
agaugguaaaaagaagaaaaagaag

SEQ ID NO: 955 - DNA, 25 bp, Artificial Sequence
  Description of Artificial Sequence: Synthetic oligonucleotide
  Description of Combined DNA/RNA Molecule: Synthetic oligonucleotide
gaugguaaaaagaagaaaaagaagt

SEQ ID NO: 956 - RNA, 25 nt, Artificial Sequence
  Description of Artificial Sequence: Synthetic oligonucleotide
ugguaaaaagaagaaaaagaaguca

SEQ ID NO: 957 - RNA, 25 nt, Artificial Sequence
  Description of Artificial Sequence: Synthetic oligonucleotide
gguaaaaagaagaaaaagaagucaa

SEQ ID NO: 958 - RNA, 25 nt, Artificial Sequence
  Description of Artificial Sequence: Synthetic oligonucleotide
aaagaagaaaaagaagucaaagaca

SEQ ID NO: 959 - RNA, 25 nt, Artificial Sequence
  Description of Artificial Sequence: Synthetic oligonucleotide
aagaagaaaaagaagucaaagacaa

SEQ ID NO: 960 - RNA, 25 nt, Artificial Sequence
  Description of Artificial Sequence: Synthetic oligonucleotide
agaagaaaaagaagucaaagacaaa

SEQ ID NO: 961 - RNA, 25 nt, Artificial Sequence
  Description of Artificial Sequence: Synthetic oligonucleotide
aaagacaaaguguguaauuauguaa

SEQ ID NO: 962 - RNA, 25 nt, Artificial Sequence
  Description of Artificial Sequence: Synthetic oligonucleotide
aagacaaaguguguaauuauguaaa

SEQ ID NO: 963 - RNA, 25 nt, Artificial Sequence
  Description of Artificial Sequence: Synthetic oligonucleotide
caaaguguguaauuauguaaauaca

SEQ ID NO: 964 - DNA, 25 bp, Artificial Sequence
  Description of Artificial Sequence: Synthetic oligonucleotide
  Description of Combined DNA/RNA Molecule: Synthetic oligonucleotide
aaguguguaauuauguaaauacaat

SEQ ID NO: 965 - DNA, 25 bp, Artificial Sequence
  Description of Artificial Sequence: Synthetic oligonucleotide
  Description of Combined DNA/RNA Molecule: Synthetic oligonucleotide
guguaauuauguaaauacaauuugt

SEQ ID NO: 966 - RNA, 25 nt, Artificial Sequence
  Description of Artificial Sequence: Synthetic oligonucleotide
guaauuauguaaauacaauuuguac

SEQ ID NO: 967 - DNA, 25 bp, Artificial Sequence
  Description of Artificial Sequence: Synthetic oligonucleotide
  Description of Combined DNA/RNA Molecule: Synthetic oligonucleotide
aauuauguaaauacaauuuguactt

SEQ ID NO: 968 - DNA, 25 bp, Artificial Sequence
  Description of Artificial Sequence: Synthetic oligonucleotide
  Description of Combined DNA/RNA Molecule: Synthetic oligonucleotide
auuauguaaauacaauuuguacutt

SEQ ID NO: 969 - DNA, 25 bp, Artificial Sequence
  Description of Artificial Sequence: Synthetic oligonucleotide
  Description of Combined DNA/RNA Molecule: Synthetic oligonucleotide
uguaaauacaauuuguacuuuuutc

SEQ ID NO: 970 - DNA, 25 bp, Artificial Sequence
  Description of Artificial Sequence: Synthetic oligonucleotide
  Description of Combined DNA/RNA Molecule: Synthetic oligonucleotide
guaaauacaauuuguacuuuuuuct

SEQ ID NO: 971 - DNA, 25 bp, Artificial Sequence
  Description of Artificial Sequence: Synthetic oligonucleotide
  Description of Combined DNA/RNA Molecule: Synthetic oligonucleotide
uaaauacaauuuguacuuuuuuctt

SEQ ID NO: 972 - DNA, 25 bp, Artificial Sequence
  Description of Artificial Sequence: Synthetic oligonucleotide
  Description of Combined DNA/RNA Molecule: Synthetic oligonucleotide
aaauacaauuuguacuuuuuucuta

SEQ ID NO: 973 - DNA, 25 bp, Artificial Sequence
  Description of Artificial Sequence: Synthetic oligonucleotide
  Description of Combined DNA/RNA Molecule: Synthetic oligonucleotide
aauuuguacuuuuuucuuaaggcat

SEQ ID NO: 974 - DNA, 25 bp, Artificial Sequence
  Description of Artificial Sequence: Synthetic oligonucleotide
  Description of Combined DNA/RNA Molecule: Synthetic oligonucleotide
auuuguacuuuuuucuuaaggcata

SEQ ID NO: 975 - RNA, 25 nt, Artificial Sequence
  Description of Artificial Sequence: Synthetic oligonucleotide
cuaguacaagugguaauuuuuguac

SEQ ID NO: 976 - RNA, 25 nt, Artificial Sequence
  Description of Artificial Sequence: Synthetic oligonucleotide
uaguacaagugguaauuuuuguaca

SEQ ID NO: 977 - RNA, 25 nt, Artificial Sequence
  Description of Artificial Sequence: Synthetic oligonucleotide
aagugguaauuuuuguacauuacac

SEQ ID NO: 978 - DNA, 25 bp, Artificial Sequence
  Description of Artificial Sequence: Synthetic oligonucleotide
  Description of Combined DNA/RNA Molecule: Synthetic oligonucleotide
agugguaauuuuuguacauuacact

SEQ ID NO: 979 - DNA, 25 bp, Artificial Sequence
  Description of Artificial Sequence: Synthetic oligonucleotide
  Description of Combined DNA/RNA Molecule: Synthetic oligonucleotide
auuuuuguacauuacacuaaauuat

SEQ ID NO: 980 - DNA, 25 bp, Artificial Sequence
  Description of Artificial Sequence: Synthetic oligonucleotide
  Description of Combined DNA/RNA Molecule: Synthetic oligonucleotide
uuuuuguacauuacacuaaauuatt

SEQ ID NO: 981 - DNA, 25 bp, Artificial Sequence
  Description of Artificial Sequence: Synthetic oligonucleotide
  Description of Combined DNA/RNA Molecule: Synthetic oligonucleotide
uuuuguacauuacacuaaauuauta

SEQ ID NO: 982 - RNA, 25 nt, Artificial Sequence
  Description of Artificial Sequence: Synthetic oligonucleotide
uuuguacauuacacuaaauuauuag

SEQ ID NO: 983 - RNA, 25 nt, Artificial Sequence
  Description of Artificial Sequence: Synthetic oligonucleotide
uuguacauuacacuaaauuauuagc

SEQ ID NO: 984 - RNA, 25 nt, Artificial Sequence
  Description of Artificial Sequence: Synthetic oligonucleotide
cuaaauuauuagcauuuguuuuagc

SEQ ID NO: 985 - DNA, 25 bp, Artificial Sequence
  Description of Artificial Sequence: Synthetic oligonucleotide
  Description of Combined DNA/RNA Molecule: Synthetic oligonucleotide
aaauuauuagcauuuguuuuagcat

SEQ ID NO: 986 - DNA, 25 bp, Artificial Sequence
  Description of Artificial Sequence: Synthetic oligonucleotide
  Description of Combined DNA/RNA Molecule: Synthetic oligonucleotide
aauuauuagcauuuguuuuagcatt

SEQ ID NO: 987 - DNA, 25 bp, Artificial Sequence
  Description of Artificial Sequence: Synthetic oligonucleotide
  Description of Combined DNA/RNA Molecule: Synthetic oligonucleotide
uuagcauuuguuuuagcauuaccta

SEQ ID NO: 988 - DNA, 25 bp, Artificial Sequence
  Description of Artificial Sequence: Synthetic oligonucleotide
  Description of Combined DNA/RNA Molecule: Synthetic oligonucleotide
uuuguuuuagcauuaccuaauuutt

SEQ ID NO: 989 - DNA, 25 bp, Artificial Sequence
  Description of Artificial Sequence: Synthetic oligonucleotide
  Description of Combined DNA/RNA Molecule: Synthetic oligonucleotide
uuguuuuagcauuaccuaauuuutt

SEQ ID NO: 990 - DNA, 25 bp, Artificial Sequence
  Description of Artificial Sequence: Synthetic oligonucleotide
  Description of Combined DNA/RNA Molecule: Synthetic oligonucleotide
guuuuagcauuaccuaauuuuuutc

SEQ ID NO: 991 - RNA, 25 nt, Artificial Sequence
  Description of Artificial Sequence: Synthetic oligonucleotide
uuuuagcauuaccuaauuuuuuucc

SEQ ID NO: 992 - DNA, 25 bp, Artificial Sequence
  Description of Artificial Sequence: Synthetic oligonucleotide
  Description of Combined DNA/RNA Molecule: Synthetic oligonucleotide
uuuagcauuaccuaauuuuuuucct

SEQ ID NO: 993 - DNA, 25 bp, Artificial Sequence
  Description of Artificial Sequence: Synthetic oligonucleotide
  Description of Combined DNA/RNA Molecule: Synthetic oligonucleotide
uuagcauuaccuaauuuuuuucctg

SEQ ID NO: 994 - DNA, 25 bp, Artificial Sequence
  Description of Artificial Sequence: Synthetic oligonucleotide
  Description of Combined DNA/RNA Molecule: Synthetic oligonucleotide
cuguuagcuuuuaccuuaaaugctt

SEQ ID NO: 995 - DNA, 25 bp, Artificial Sequence
  Description of Artificial Sequence: Synthetic oligonucleotide
  Description of Combined DNA/RNA Molecule: Synthetic oligonucleotide
uguuagcuuuuaccuuaaaugcuta

SEQ ID NO: 996 - RNA, 25 nt, Artificial Sequence
  Description of Artificial Sequence: Synthetic oligonucleotide
cuuuuaccuuaaaugcuuauuuuaa

SEQ ID NO: 997 - RNA, 25 nt, Artificial Sequence
  Description of Artificial Sequence: Synthetic oligonucleotide
uuuuaccuuaaaugcuuauuuuaaa

SEQ ID NO: 998 - RNA, 25 nt, Artificial Sequence
  Description of Artificial Sequence: Synthetic oligonucleotide
uuuaccuuaaaugcuuauuuuaaaa

SEQ ID NO: 999 - RNA, 25 nt, Artificial Sequence
  Description of Artificial Sequence: Synthetic oligonucleotide
uuaaaugcuuauuuuaaaaugacag

SEQ ID NO: 1000 - DNA, 25 bp, Artificial Sequence
  Description of Artificial Sequence: Synthetic oligonucleotide
  Description of Combined DNA/RNA Molecule: Synthetic oligonucleotide
uaaaugcuuauuuuaaaaugacagt

SEQ ID NO: 1001 - DNA, 25 bp, Artificial Sequence
  Description of Artificial Sequence: Synthetic oligonucleotide
  Description of Combined DNA/RNA Molecule: Synthetic oligonucleotide
cuuauuuuaaaaugacaguggaagt

SEQ ID NO: 1002 - DNA, 25 bp, Artificial Sequence
  Description of Artificial Sequence: Synthetic oligonucleotide
  Description of Combined DNA/RNA Molecule: Synthetic oligonucleotide
uauuuuaaaaugacaguggaagutt

SEQ ID NO: 1003 - RNA, 25 nt, Artificial Sequence
  Description of Artificial Sequence: Synthetic oligonucleotide
ggaaguuuuuuuuuccucuaagugc

SEQ ID NO: 1004 - RNA, 25 nt, Artificial Sequence
  Description of Artificial Sequence: Synthetic oligonucleotide
aaguuuuuuuuuccucuaagugcca

SEQ ID NO: 1005 - RNA, 25 nt, Artificial Sequence
  Description of Artificial Sequence: Synthetic oligonucleotide
aguuuuuuuuuccucuaagugccag

SEQ ID NO: 1006 - DNA, 25 bp, Artificial Sequence
  Description of Artificial Sequence: Synthetic oligonucleotide
  Description of Combined DNA/RNA Molecule: Synthetic oligonucleotide
uugguuuuugaacuagcaaugcctg

SEQ ID NO: 1007 - DNA, 25 bp, Artificial Sequence
  Description of Artificial Sequence: Synthetic oligonucleotide
  Description of Combined DNA/RNA Molecule: Synthetic oligonucleotide
cugugaaaaagaaacugaauaccta

SEQ ID NO: 1008 - DNA, 25 bp, Artificial Sequence
  Description of Artificial Sequence: Synthetic oligonucleotide
  Description of Combined DNA/RNA Molecule: Synthetic oligonucleotide
aaagaaacugaauaccuaagauutc

SEQ ID NO: 1009 - DNA, 25 bp, Artificial Sequence
  Description of Artificial Sequence: Synthetic oligonucleotide
  Description of Combined DNA/RNA Molecule: Synthetic oligonucleotide
aagaaacugaauaccuaagauuuct

SEQ ID NO: 1010 - DNA, 25 bp, Artificial Sequence
  Description of Artificial Sequence: Synthetic oligonucleotide
  Description of Combined DNA/RNA Molecule: Synthetic oligonucleotide
cugaauaccuaagauuucugucutg

SEQ ID NO: 1011 - DNA, 25 bp, Artificial Sequence
  Description of Artificial Sequence: Synthetic oligonucleotide
  Description of Combined DNA/RNA Molecule: Synthetic oligonucleotide
caguugauuacuucuuauuuuuctt

SEQ ID NO: 1012 - DNA, 25 bp, Artificial Sequence
  Description of Artificial Sequence: Synthetic oligonucleotide
  Description of Combined DNA/RNA Molecule: Synthetic oligonucleotide
aguugauuacuucuuauuuuucuta

SEQ ID NO: 1013 - RNA, 25 nt, Artificial Sequence
  Description of Artificial Sequence: Synthetic oligonucleotide
gauuacuucuuauuuuucuuaccaa

SEQ ID NO: 1014 - DNA, 25 bp, Artificial Sequence
  Description of Artificial Sequence: Synthetic oligonucleotide
  Description of Combined DNA/RNA Molecule: Synthetic oligonucleotide
cuuauuuuucuuaccaauugugaat

SEQ ID NO: 1015 - DNA, 25 bp, Artificial Sequence
  Description of Artificial Sequence: Synthetic oligonucleotide
  Description of Combined DNA/RNA Molecule: Synthetic oligonucleotide
uuauuuuucuuaccaauugugaatg

SEQ ID NO: 1016 - DNA, 25 bp, Artificial Sequence
  Description of Artificial Sequence: Synthetic oligonucleotide
  Description of Combined DNA/RNA Molecule: Synthetic oligonucleotide
uauuuuucuuaccaauugugaaugt

SEQ ID NO: 1017 - RNA, 25 nt, Artificial Sequence
  Description of Artificial Sequence: Synthetic oligonucleotide
guuggugugaaacaaauuaaugaag

SEQ ID NO: 1018 - DNA, 25 bp, Artificial Sequence
  Description of Artificial Sequence: Synthetic oligonucleotide
  Description of Combined DNA/RNA Molecule: Synthetic oligonucleotide
ggugugaaacaaauuaaugaagctt

SEQ ID NO: 1019 - DNA, 25 bp, Artificial Sequence
  Description of Artificial Sequence: Synthetic oligonucleotide
  Description of Combined DNA/RNA Molecule: Synthetic oligonucleotide
gugugaaacaaauuaaugaagcutt

SEQ ID NO: 1020 - DNA, 25 bp, Artificial Sequence
  Description of Artificial Sequence: Synthetic oligonucleotide
  Description of Combined DNA/RNA Molecule: Synthetic oligonucleotide
caaauuaaugaagcuuuugaaucat

SEQ ID NO: 1021 - DNA, 25 bp, Artificial Sequence
  Description of Artificial Sequence: Synthetic oligonucleotide
  Description of Combined DNA/RNA Molecule: Synthetic oligonucleotide
aaauuaaugaagcuuuugaaucatc

SEQ ID NO: 1022 - DNA, 25 bp, Artificial Sequence
  Description of Artificial Sequence: Synthetic oligonucleotide
  Description of Combined DNA/RNA Molecule: Synthetic oligonucleotide
uguguuuuaucuagucacauaaatg

SEQ ID NO: 1023 - RNA, 25 nt, Artificial Sequence
  Description of Artificial Sequence: Synthetic oligonucleotide
guguuuuaucuagucacauaaaugg

SEQ ID NO: 1024 - DNA, 25 bp, Artificial Sequence
  Description of Artificial Sequence: Synthetic oligonucleotide
  Description of Combined DNA/RNA Molecule: Synthetic oligonucleotide
uuuuaucuagucacauaaauggatt

SEQ ID NO: 1025 - DNA, 25 bp, Artificial Sequence
  Description of Artificial Sequence: Synthetic oligonucleotide
  Description of Combined DNA/RNA Molecule: Synthetic oligonucleotide
uuuaucuagucacauaaauggauta

SEQ ID NO: 1026 - RNA, 25 nt, Artificial Sequence
  Description of Artificial Sequence: Synthetic oligonucleotide
cuagucacauaaauggauuaauuac

SEQ ID NO: 1027 - DNA, 25 bp, Artificial Sequence
  Description of Artificial Sequence: Synthetic oligonucleotide
  Description of Combined DNA/RNA Molecule: Synthetic oligonucleotide
uagucacauaaauggauuaauuact

SEQ ID NO: 1028 - RNA, 25 nt, Artificial Sequence
  Description of Artificial Sequence: Synthetic oligonucleotide
uaaauggauuaauuacuaauuucag

SEQ ID NO: 1029 - DNA, 25 bp, Artificial Sequence
  Description of Artificial Sequence: Synthetic oligonucleotide
  Description of Combined DNA/RNA Molecule: Synthetic oligonucleotide
aaauggauuaauuacuaauuucagt

SEQ ID NO: 1030 - RNA, 25 nt, Artificial Sequence
  Description of Artificial Sequence: Synthetic oligonucleotide
gauuaauuacuaauuucaguugaga

SEQ ID NO: 1031 - RNA, 25 nt, Artificial Sequence
  Description of Artificial Sequence: Synthetic oligonucleotide
uuaauuacuaauuucaguugagacc

SEQ ID NO: 1032 - DNA, 25 bp, Artificial Sequence
  Description of Artificial Sequence: Synthetic oligonucleotide
  Description of Combined DNA/RNA Molecule: Synthetic oligonucleotide
uaauuacuaauuucaguugagacct

SEQ ID NO: 1033 - DNA, 25 bp, Artificial Sequence
  Description of Artificial Sequence: Synthetic oligonucleotide
  Description of Combined DNA/RNA Molecule: Synthetic oligonucleotide
aauuacuaauuucaguugagacctt

SEQ ID NO: 1034 - RNA, 25 nt, Artificial Sequence
  Description of Artificial Sequence: Synthetic oligonucleotide
auugguuuuuacugaaacauugagg

SEQ ID NO: 1035 - RNA, 25 nt, Artificial Sequence
  Description of Artificial Sequence: Synthetic oligonucleotide
guuuuuacugaaacauugagggaac

SEQ ID NO: 1036 - RNA, 25 nt, Artificial Sequence
  Description of Artificial Sequence: Synthetic oligonucleotide
uuuuuacugaaacauugagggaaca

SEQ ID NO: 1037 - DNA, 25 bp, Artificial Sequence
  Description of Artificial Sequence: Synthetic oligonucleotide
  Description of Combined DNA/RNA Molecule: Synthetic oligonucleotide
ugagggaacacaaauuuaugggctt

SEQ ID NO: 1038 - DNA, 25 bp, Artificial Sequence
  Description of Artificial Sequence: Synthetic oligonucleotide
  Description of Combined DNA/RNA Molecule: Synthetic oligonucleotide
gagggaacacaaauuuaugggcutc

SEQ ID NO: 1039 - RNA, 25 nt, Artificial Sequence
  Description of Artificial Sequence: Synthetic oligonucleotide
augaauguaaaguuacacuguucac

SEQ ID NO: 1040 - RNA, 25 nt, Artificial Sequence
  Description of Artificial Sequence: Synthetic oligonucleotide
ugaauguaaaguuacacuguucaca

SEQ ID NO: 1041 - RNA, 25 nt, Artificial Sequence
  Description of Artificial Sequence: Synthetic oligonucleotide
aaaauauuauauuuuuucuauaaaa

SEQ ID NO: 1042 - RNA, 25 nt, Artificial Sequence
  Description of Artificial Sequence: Synthetic oligonucleotide
aaauauuauauuuuuucuauaaaaa

SEQ ID NO: 1043 - RNA, 25 nt, Artificial Sequence
  Description of Artificial Sequence: Synthetic oligonucleotide
aauauuauauuuuuucuauaaaaag

SEQ ID NO: 1044 - RNA, 25 nt, Artificial Sequence
  Description of Artificial Sequence: Synthetic oligonucleotide
auauuauauuuuuucuauaaaaaga

SEQ ID NO: 1045 - RNA, 25 nt, Artificial Sequence
  Description of Artificial Sequence: Synthetic oligonucleotide
auuauauuuuuucuauaaaaagaaa

SEQ ID NO: 1046 - RNA, 25 nt, Artificial Sequence
  Description of Artificial Sequence: Synthetic oligonucleotide
uuauauuuuuucuauaaaaagaaaa

SEQ ID NO: 1047 - RNA, 25 nt, Artificial Sequence
  Description of Artificial Sequence: Synthetic oligonucleotide
uauauuuuuucuauaaaaagaaaaa

SEQ ID NO: 1048 - RNA, 25 nt, Artificial Sequence
  Description of Artificial Sequence: Synthetic oligonucleotide
auauuuuuucuauaaaaagaaaaaa

SEQ ID NO: 1049 - RNA, 25 nt, Artificial Sequence
  Description of Artificial Sequence: Synthetic oligonucleotide
uauuuuuucuauaaaaagaaaaaaa

SEQ ID NO: 1050 - DNA, 25 bp, Artificial Sequence
  Description of Artificial Sequence: Synthetic oligonucleotide
  Description of Combined DNA/RNA Molecule: Synthetic oligonucleotide
auuuuuucuauaaaaagaaaaaaat

SEQ ID NO: 1051 - DNA, 25 bp, Artificial Sequence
  Description of Artificial Sequence: Synthetic oligonucleotide
  Description of Combined DNA/RNA Molecule: Synthetic oligonucleotide
uuuuuucuauaaaaagaaaaaaatg

SEQ ID NO: 1052 - RNA, 25 nt, Artificial Sequence
  Description of Artificial Sequence: Synthetic oligonucleotide
uuuuucuauaaaaagaaaaaaaugg

SEQ ID NO: 1053 - RNA, 25 nt, Artificial Sequence
  Description of Artificial Sequence: Synthetic oligonucleotide
cuauaaaaagaaaaaaauggaaaaa

SEQ ID NO: 1054 - RNA, 25 nt, Artificial Sequence
  Description of Artificial Sequence: Synthetic oligonucleotide
uauaaaaagaaaaaaauggaaaaaa

SEQ ID NO: 1055 - DNA, 25 bp, Artificial Sequence
  Description of Artificial Sequence: Synthetic oligonucleotide
  Description of Combined DNA/RNA Molecule: Synthetic oligonucleotide
uaaaaagaaaaaaauggaaaaaaat

SEQ ID NO: 1056 - DNA, 25 bp, Artificial Sequence
  Description of Artificial Sequence: Synthetic oligonucleotide
  Description of Combined DNA/RNA Molecule: Synthetic oligonucleotide
aaaaagaaaaaaauggaaaaaaatt

SEQ ID NO: 1057 - DNA, 25 bp, Artificial Sequence
  Description of Artificial Sequence: Synthetic oligonucleotide
  Description of Combined DNA/RNA Molecule: Synthetic oligonucleotide
aaaagaaaaaaauggaaaaaaauta

SEQ ID NO: 1058 - RNA, 25 nt, Artificial Sequence
  Description of Artificial Sequence: Synthetic oligonucleotide
aaagaaaaaaauggaaaaaaauuac

SEQ ID NO: 1059 - RNA, 25 nt, Artificial Sequence
  Description of Artificial Sequence: Synthetic oligonucleotide
aagaaaaaaauggaaaaaaauuaca

SEQ ID NO: 1060 - RNA, 25 nt, Artificial Sequence
  Description of Artificial Sequence: Synthetic oligonucleotide
agaaaaaaauggaaaaaaauuacaa

SEQ ID NO: 1061 - RNA, 25 nt, Artificial Sequence
  Description of Artificial Sequence: Synthetic oligonucleotide
gaaaaaaauggaaaaaaauuacaag

SEQ ID NO: 1062 - RNA, 25 nt, Artificial Sequence
  Description of Artificial Sequence: Synthetic oligonucleotide
aaaauggaaaaaaauuacaaggcaa

SEQ ID NO: 1063 - DNA, 25 bp, Artificial Sequence
  Description of Artificial Sequence: Synthetic oligonucleotide
  Description of Combined DNA/RNA Molecule: Synthetic oligonucleotide
aaauggaaaaaaauuacaaggcaat

SEQ ID NO: 1064 - RNA, 25 nt, Artificial Sequence
  Description of Artificial Sequence: Synthetic oligonucleotide
gaaaaaaauuacaaggcaauggaaa

SEQ ID NO: 1065 - RNA, 25 nt, Artificial Sequence
  Description of Artificial Sequence: Synthetic oligonucleotide
aaaaaaauuacaaggcaauggaaac

SEQ ID NO: 1066 - DNA, 25 bp, Artificial Sequence
  Description of Artificial Sequence: Synthetic oligonucleotide
  Description of Combined DNA/RNA Molecule: Synthetic oligonucleotide
aaaaaauuacaaggcaauggaaact

SEQ ID NO: 1067 - DNA, 25 bp, Artificial Sequence
  Description of Artificial Sequence: Synthetic oligonucleotide
  Description of Combined DNA/RNA Molecule: Synthetic oligonucleotide
cauuuccuuuucacauuagauaaat

SEQ ID NO: 1068 - DNA, 25 bp, Artificial Sequence
  Description of Artificial Sequence: Synthetic oligonucleotide
  Description of Combined DNA/RNA Molecule: Synthetic oligonucleotide
cuuuucacauuagauaaauuacuat

SEQ ID NO: 1069 - DNA, 25 bp, Artificial Sequence
  Description of Artificial Sequence: Synthetic oligonucleotide
  Description of Combined DNA/RNA Molecule: Synthetic oligonucleotide
cauuagauaaauuacuauaaagact

SEQ ID NO: 1070 - DNA, 25 bp, Artificial Sequence
  Description of Artificial Sequence: Synthetic oligonucleotide
  Description of Combined DNA/RNA Molecule: Synthetic oligonucleotide
auuagauaaauuacuauaaagactc

SEQ ID NO: 1071 - RNA, 25 nt, Artificial Sequence
  Description of Artificial Sequence: Synthetic oligonucleotide
uuagauaaauuacuauaaagacucc

SEQ ID NO: 1072 - RNA, 25 nt, Artificial Sequence
  Description of Artificial Sequence: Synthetic oligonucleotide
uaugaaauggggauuauuauagcaa

SEQ ID NO: 1073 - RNA, 25 nt, Artificial Sequence
  Description of Artificial Sequence: Synthetic oligonucleotide
gggauuauuauagcaaccauuuugg

SEQ ID NO: 1074 - DNA, 25 bp, Artificial Sequence
  Description of Artificial Sequence: Synthetic oligonucleotide
  Description of Combined DNA/RNA Molecule: Synthetic oligonucleotide
cuauauuuacaugcuacuaaauutt

SEQ ID NO: 1075 - DNA, 25 bp, Artificial Sequence
  Description of Artificial Sequence: Synthetic oligonucleotide
  Description of Combined DNA/RNA Molecule: Synthetic oligonucleotide
uauauuuacaugcuacuaaauuutt

SEQ ID NO: 1076 - DNA, 25 bp, Artificial Sequence
  Description of Artificial Sequence: Synthetic oligonucleotide
  Description of Combined DNA/RNA Molecule: Synthetic oligonucleotide
auauuuacaugcuacuaaauuuuta

SEQ ID NO: 1077 - DNA, 25 bp, Artificial Sequence
  Description of Artificial Sequence: Synthetic oligonucleotide
  Description of Combined DNA/RNA Molecule: Synthetic oligonucleotide
uauuuacaugcuacuaaauuuuuat

SEQ ID NO: 1078 - DNA, 25 bp, Artificial Sequence
  Description of Artificial Sequence: Synthetic oligonucleotide
  Description of Combined DNA/RNA Molecule: Synthetic oligonucleotide
auuuacaugcuacuaaauuuuuata

SEQ ID NO: 1079 - DNA, 25 bp, Artificial Sequence
  Description of Artificial Sequence: Synthetic oligonucleotide
  Description of Combined DNA/RNA Molecule: Synthetic oligonucleotide
caugcuacuaaauuuuuauaauaat

SEQ ID NO: 1080 - RNA, 25 nt, Artificial Sequence
  Description of Artificial Sequence: Synthetic oligonucleotide
cuaaauuuuuauaauaauugaaaag

SEQ ID NO: 1081 - RNA, 25 nt, Artificial Sequence
  Description of Artificial Sequence: Synthetic oligonucleotide
uaaauuuuuauaauaauugaaaaga

SEQ ID NO: 1082 - DNA, 25 bp, Artificial Sequence
  Description of Artificial Sequence: Synthetic oligonucleotide
  Description of Combined DNA/RNA Molecule: Synthetic oligonucleotide
aauuuuuauaauaauugaaaagatt

SEQ ID NO: 1083 - DNA, 25 bp, Artificial Sequence
  Description of Artificial Sequence: Synthetic oligonucleotide
  Description of Combined DNA/RNA Molecule: Synthetic oligonucleotide
auuuuuauaauaauugaaaagautt

SEQ ID NO: 1084 - DNA, 25 bp, Artificial Sequence
  Description of Artificial Sequence: Synthetic oligonucleotide
  Description of Combined DNA/RNA Molecule: Synthetic oligonucleotide
uuuuuauaauaauugaaaagauutt

SEQ ID NO: 1085 - DNA, 25 bp, Artificial Sequence
  Description of Artificial Sequence: Synthetic oligonucleotide
  Description of Combined DNA/RNA Molecule: Synthetic oligonucleotide
uuuuauaauaauugaaaagauuuta

SEQ ID NO: 1086 - RNA, 25 nt, Artificial Sequence
  Description of Artificial Sequence: Synthetic oligonucleotide
uuuauaauaauugaaaagauuuuaa

SEQ ID NO: 1087 - RNA, 25 nt, Artificial Sequence
  Description of Artificial Sequence: Synthetic oligonucleotide
uuauaauaauugaaaagauuuuaac

SEQ ID NO: 1088 - RNA, 25 nt, Artificial Sequence
  Description of Artificial Sequence: Synthetic oligonucleotide
uauaauaauugaaaagauuuuaaca

SEQ ID NO: 1089 - RNA, 25 nt, Artificial Sequence
  Description of Artificial Sequence: Synthetic oligonucleotide
auaauaauugaaaagauuuuaacaa

SEQ ID NO: 1090 - RNA, 25 nt, Artificial Sequence
  Description of Artificial Sequence: Synthetic oligonucleotide
uaauaauugaaaagauuuuaacaag

SEQ ID NO: 1091 - DNA, 25 bp, Artificial Sequence
  Description of Artificial Sequence: Synthetic oligonucleotide
  Description of Artificial Sequence: Synthetic oligonucleotide
aauugaaaagauuuuaacaaguata

SEQ ID NO: 1092 - RNA, 25 nt, Artificial Sequence
  Description of Artificial Sequence: Synthetic oligonucleotide
auugaaaagauuuuaacaaguauaa

SEQ ID NO: 1093 - RNA, 25 nt, Artificial Sequence
  Description of Artificial Sequence: Synthetic oligonucleotide
ugaaaagauuuuaacaaguauaaaa

SEQ ID NO: 1094 - RNA, 25 nt, Artificial Sequence
  Description of Artificial Sequence: Synthetic oligonucleotide
gaaaagauuuuaacaaguauaaaaa

SEQ ID NO: 1095 - RNA, 25 nt, Artificial Sequence
  Description of Artificial Sequence: Synthetic oligonucleotide
aaaagauuuuaacaaguauaaaaaa

SEQ ID NO: 1096 - DNA, 25 bp, Artificial Sequence
  Description of Artificial Sequence: Synthetic oligonucleotide
  Description of Artificial Sequence: Synthetic oligonucleotide
aaagauuuuaacaaguauaaaaaat

SEQ ID NO: 1097 - DNA, 25 bp, Artificial Sequence
  Description of Artificial Sequence: Synthetic oligonucleotide
  Description of Combined DNA/RNA Molecule: Synthetic oligonucleotide
aagauuuuaacaaguauaaaaaatt

SEQ ID NO: 1098 - DNA, 25 bp, Artificial Sequence
  Description of Artificial Sequence: Synthetic oligonucleotide
  Description of Combined DNA/RNA Molecule: Synthetic oligonucleotide
agauuuuaacaaguauaaaaaautc

SEQ ID NO: 1099 - DNA, 25 bp, Artificial Sequence
  Description of Artificial Sequence: Synthetic oligonucleotide
  Description of Combined DNA/RNA Molecule: Synthetic oligonucleotide
gauuuuaacaaguauaaaaaauuct

SEQ ID NO: 1100 - DNA, 25 bp, Artificial Sequence
  Description of Artificial Sequence: Synthetic oligonucleotide
  Description of Artificial Sequence: Synthetic oligonucleotide
auuuuaacaaguauaaaaaauuctc

SEQ ID NO: 1101 - RNA, 25 nt, Artificial Sequence
  Description of Artificial Sequence: Synthetic oligonucleotide
uuuuaacaaguauaaaaaauucuca

SEQ ID NO: 1102 - DNA, 25 bp, Artificial Sequence
  Description of Artificial Sequence: Synthetic oligonucleotide
  Description of Combined DNA/RNA Molecule: Synthetic oligonucleotide
aaguauaaaaaauucucauaggaat

SEQ ID NO: 1103 - DNA, 25 bp, Artificial Sequence
  Description of Artificial Sequence: Synthetic oligonucleotide
  Description of Combined DNA/RNA Molecule: Synthetic oligonucleotide
aguauaaaaaauucucauaggaatt

SEQ ID NO: 1104 - DNA, 25 bp, Artificial Sequence
  Description of Artificial Sequence: Synthetic oligonucleotide
  Description of Combined DNA/RNA Molecule: Synthetic oligonucleotide
guauaaaaaauucucauaggaauta

SEQ ID NO: 1105 - RNA, 25 nt, Artificial Sequence
  Description of Artificial Sequence: Synthetic oligonucleotide
uauaaaaaauucucauaggaauuaa

SEQ ID NO: 1106 - RNA, 25 nt, Artificial Sequence
  Description of Artificial Sequence: Synthetic oligonucleotide
auaaaaaauucucauaggaauuaaa

SEQ ID NO: 1107 - DNA, 25 bp, Artificial Sequence
  Description of Artificial Sequence: Synthetic oligonucleotide
  Description of Combined DNA/RNA Molecule: Synthetic oligonucleotide
uaaaaaauucucauaggaauuaaat

SEQ ID NO: 1108 - DNA, 25 bp, Artificial Sequence
  Description of Artificial Sequence: Synthetic oligonucleotide
  Description of Combined DNA/RNA Molecule: Synthetic oligonucleotide
aaaaaauucucauaggaauuaaatg

SEQ ID NO: 1109 - DNA, 25 bp, Artificial Sequence
  Description of Artificial Sequence: Synthetic oligonucleotide
  Description of Combined DNA/RNA Molecule: Synthetic oligonucleotide
aaaaauucucauaggaauuaaaugt

SEQ ID NO: 1110 - RNA, 25 nt, Artificial Sequence
  Description of Artificial Sequence: Synthetic oligonucleotide
aaauucucauaggaauuaaauguag

SEQ ID NO: 1111 - DNA, 25 bp, Artificial Sequence
  Description of Artificial Sequence: Synthetic oligonucleotide
  Description of Combined DNA/RNA Molecule: Synthetic oligonucleotide
aauucucauaggaauuaaauguagt

SEQ ID NO: 1112 - DNA, 25 bp, Artificial Sequence
  Description of Artificial Sequence: Synthetic oligonucleotide
  Description of Combined DNA/RNA Molecule: Synthetic oligonucleotide
cuuucauaguauaacuuuaaauctt

SEQ ID NO: 1113 - DNA, 25 bp, Artificial Sequence
  Description of Artificial Sequence: Synthetic oligonucleotide
  Description of Combined DNA/RNA Molecule: Synthetic oligonucleotide
auaguauaacuuuaaaucuuuuctt

SEQ ID NO: 1114 - DNA, 25 bp, Artificial Sequence
  Description of Artificial Sequence: Synthetic oligonucleotide
  Description of Combined DNA/RNA Molecule: Synthetic oligonucleotide
uaguauaacuuuaaaucuuuucutc

SEQ ID NO: 1115 - DNA, 25 bp, Artificial Sequence
  Description of Artificial Sequence: Synthetic oligonucleotide
  Description of Combined DNA/RNA Molecule: Synthetic oligonucleotide
uaaaucuuuucuucaacuugaguct

SEQ ID NO: 1116 - DNA, 25 bp, Artificial Sequence
  Description of Artificial Sequence: Synthetic oligonucleotide
  Description of Combined DNA/RNA Molecule: Synthetic oligonucleotide
aaaucuuuucuucaacuugaguctt

SEQ ID NO: 1117 - RNA, 25 nt, Artificial Sequence
  Description of Artificial Sequence: Synthetic oligonucleotide
cuugagucuuugaagauaguuuuaa

SEQ ID NO: 1118 - DNA, 25 bp, Artificial Sequence
  Description of Artificial Sequence: Synthetic oligonucleotide
  Description of Combined DNA/RNA Molecule: Synthetic oligonucleotide
ugagucuuugaagauaguuuuaatt

SEQ ID NO: 1119 - DNA, 25 bp, Artificial Sequence
  Description of Artificial Sequence: Synthetic oligonucleotide
  Description of Combined DNA/RNA Molecule: Synthetic oligonucleotide
gagucuuugaagauaguuuuaautc

SEQ ID NO: 1120 - RNA, 25 nt, Artificial Sequence
  Description of Artificial Sequence: Synthetic oligonucleotide
gauaguuuuaauucugcuugugaca

SEQ ID NO: 1121 - DNA, 25 bp, Artificial Sequence
  Description of Artificial Sequence: Synthetic oligonucleotide
  Description of Combined DNA/RNA Molecule: Synthetic oligonucleotide
auaguuuuaauucugcuugugacat

SEQ ID NO: 1122 - DNA, 25 bp, Artificial Sequence
  Description of Artificial Sequence: Synthetic oligonucleotide
  Description of Combined DNA/RNA Molecule: Synthetic oligonucleotide
uaguuuuaauucugcuugugacatt

SEQ ID NO: 1123 - RNA, 25 nt, Artificial Sequence
  Description of Artificial Sequence: Synthetic oligonucleotide
cuugugacauuaaaagauuauuugg

SEQ ID NO: 1124 - RNA, 25 nt, Artificial Sequence
  Description of Artificial Sequence: Synthetic oligonucleotide
cauugcuuuuguuucuuaagaaaac

SEQ ID NO: 1125 - RNA, 25 nt, Artificial Sequence
  Description of Artificial Sequence: Synthetic oligonucleotide
auugcuuuuguuucuuaagaaaaca

SEQ ID NO: 1126 - DNA, 25 bp, Artificial Sequence
  Description of Artificial Sequence: Synthetic oligonucleotide
  Description of Combined DNA/RNA Molecule: Synthetic oligonucleotide
uuuguuucuuaagaaaacaaacuct

SEQ ID NO: 1127 - RNA, 25 nt, Artificial Sequence
  Description of Artificial Sequence: Synthetic oligonucleotide
cuuaagaaaacaaacucuuuuuuaa

SEQ ID NO: 1128 - RNA, 25 nt, Artificial Sequence
  Description of Artificial Sequence: Synthetic oligonucleotide
uuaagaaaacaaacucuuuuuuaaa

SEQ ID NO: 1129 - RNA, 25 nt, Artificial Sequence
  Description of Artificial Sequence: Synthetic oligonucleotide
uaagaaaacaaacucuuuuuuaaaa

SEQ ID NO: 1130 - RNA, 25 nt, Artificial Sequence
  Description of Artificial Sequence: Synthetic oligonucleotide
aagaaaacaaacucuuuuuuaaaaa

SEQ ID NO: 1131 - DNA, 25 bp, Artificial Sequence
  Description of Artificial Sequence: Synthetic oligonucleotide
  Description of Combined DNA/RNA Molecule: Synthetic oligonucleotide
agaaaacaaacucuuuuuuaaaaat

SEQ ID NO: 1132 - DNA, 25 bp, Artificial Sequence
  Description of Artificial Sequence: Synthetic oligonucleotide
  Description of Combined DNA/RNA Molecule: Synthetic oligonucleotide
gaaaacaaacucuuuuuuaaaaatt

SEQ ID NO: 1133 - DNA, 25 bp, Artificial Sequence
  Description of Artificial Sequence: Synthetic oligonucleotide
  Description of Combined DNA/RNA Molecule: Synthetic oligonucleotide
aaaacaaacucuuuuuuaaaaauta

SEQ ID NO: 1134 - DNA, 25 bp, Artificial Sequence
  Description of Artificial Sequence: Synthetic oligonucleotide
  Description of Combined DNA/RNA Molecule: Synthetic oligonucleotide
caaacucuuuuuuaaaaauuacutt

SEQ ID NO: 1135 - DNA, 25 bp, Artificial Sequence
  Description of Artificial Sequence: Synthetic oligonucleotide
  Description of Combined DNA/RNA Molecule: Synthetic oligonucleotide
cuuuuuuaaaaauuacuuuuaaata

SEQ ID NO: 1136 - DNA, 25 bp, Artificial Sequence
  Description of Artificial Sequence: Synthetic oligonucleotide
  Description of Combined DNA/RNA Molecule: Synthetic oligonucleotide
uuuuuuaaaaauuacuuuuaaauat

SEQ ID NO: 1137 - DNA, 25 bp, Artificial Sequence
  Description of Artificial Sequence: Synthetic oligonucleotide
  Description of Combined DNA/RNA Molecule: Synthetic oligonucleotide
uuuuuaaaaauuacuuuuaaauatt

SEQ ID NO: 1138 - DNA, 25 bp, Artificial Sequence
  Description of Artificial Sequence: Synthetic oligonucleotide
  Description of Combined DNA/RNA Molecule: Synthetic oligonucleotide
uuuuaaaaauuacuuuuaaauauta

SEQ ID NO: 1139 - RNA, 25 nt, Artificial Sequence
  Description of Artificial Sequence: Synthetic oligonucleotide
uuuaaaaauuacuuuuaaauauuaa

SEQ ID NO: 1140 - RNA, 25 nt, Artificial Sequence
  Description of Artificial Sequence: Synthetic oligonucleotide
uuaaaaauuacuuuuaaauauuaac

SEQ ID NO: 1141 - DNA, 25 bp, Artificial Sequence
  Description of Artificial Sequence: Synthetic oligonucleotide
  Description of Combined DNA/RNA Molecule: Synthetic oligonucleotide
uaaaaauuacuuuuaaauauuaact

SEQ ID NO: 1142 - DNA, 25 bp, Artificial Sequence
  Description of Artificial Sequence: Synthetic oligonucleotide
  Description of Combined DNA/RNA Molecule: Synthetic oligonucleotide
aaaaauuacuuuuaaauauuaactc

SEQ ID NO: 1143 - RNA, 25 nt, Artificial Sequence
  Description of Artificial Sequence: Synthetic oligonucleotide
aaaauuacuuuuaaauauuaacuca

SEQ ID NO: 1144 - DNA, 25 bp, Artificial Sequence
  Description of Artificial Sequence: Synthetic oligonucleotide
  Description of Combined DNA/RNA Molecule: Synthetic oligonucleotide
cuuuuaaauauuaacucaaaagutg

SEQ ID NO: 1145 - RNA, 25 nt, Artificial Sequence
  Description of Artificial Sequence: Synthetic oligonucleotide
uuuuaaauauuaacucaaaaguuga

SEQ ID NO: 1146 - RNA, 25 nt, Artificial Sequence
  Description of Artificial Sequence: Synthetic oligonucleotide
uuaaauauuaacucaaaaguugaga

SEQ ID NO: 1147 - DNA, 25 bp, Artificial Sequence
  Description of Artificial Sequence: Synthetic oligonucleotide
  Description of Combined DNA/RNA Molecule: Synthetic oligonucleotide
aaauauuaacucaaaaguugagatt

SEQ ID NO: 1148 - DNA, 25 bp, Artificial Sequence
  Description of Artificial Sequence: Synthetic oligonucleotide
  Description of Combined DNA/RNA Molecule: Synthetic oligonucleotide
aauauuaacucaaaaguugagautt

SEQ ID NO: 1149 - DNA, 25 bp, Artificial Sequence
  Description of Artificial Sequence: Synthetic oligonucleotide
  Description of Combined DNA/RNA Molecule: Synthetic oligonucleotide
auauuaacucaaaaguugagauutt

SEQ ID NO: 1150 - DNA, 25 bp, Artificial Sequence
  Description of Artificial Sequence: Synthetic oligonucleotide
  Description of Combined DNA/RNA Molecule: Synthetic oligonucleotide
uauuaacucaaaaguugagauuutg

SEQ ID NO: 1151 - DNA, 25 bp, Artificial Sequence
  Description of Artificial Sequence: Synthetic oligonucleotide
  Description of Combined DNA/RNA Molecule: Synthetic oligonucleotide
ugugccaagacauuaauuuuuuutt

SEQ ID NO: 1152 - RNA, 25 nt, Artificial Sequence
  Description of Artificial Sequence: Synthetic oligonucleotide
caagacauuaauuuuuuuuuuaaac

SEQ ID NO: 1153 - RNA, 25 nt, Artificial Sequence
  Description of Artificial Sequence: Synthetic oligonucleotide
aagacauuaauuuuuuuuuuaaaca

SEQ ID NO: 1154 - RNA, 25 nt, Artificial Sequence
  Description of Artificial Sequence: Synthetic oligonucleotide
uuaauuuuuuuuuuaaacaaugaag

SEQ ID NO: 1155 - DNA, 25 bp, Artificial Sequence
  Description of Artificial Sequence: Synthetic oligonucleotide
  Description of Combined DNA/RNA Molecule: Synthetic oligonucleotide
uaauuuuuuuuuuaaacaaugaagt

SEQ ID NO: 1156 - RNA, 25 nt, Artificial Sequence
  Description of Artificial Sequence: Synthetic oligonucleotide
auuuuuuuuuuaaacaaugaaguga

SEQ ID NO: 1157 - RNA, 25 nt, Artificial Sequence
  Description of Artificial Sequence: Synthetic oligonucleotide
uuuuuuuuuaaacaaugaagugaaa

SEQ ID NO: 1158 - RNA, 25 nt, Artificial Sequence
  Description of Artificial Sequence: Synthetic oligonucleotide
uuuuuuuuaaacaaugaagugaaaa

SEQ ID NO: 1159 - RNA, 25 nt, Artificial Sequence
  Description of Artificial Sequence: Synthetic oligonucleotide
uuuuuuuaaacaaugaagugaaaaa

SEQ ID NO: 1160 - RNA, 25 nt, Artificial Sequence
  Description of Artificial Sequence: Synthetic oligonucleotide
uuuuuuaaacaaugaagugaaaaag

SEQ ID NO: 1161 - DNA, 25 bp, Artificial Sequence
  Description of Artificial Sequence: Synthetic oligonucleotide
  Description of Combined DNA/RNA Molecule: Synthetic oligonucleotide
uuuuuaaacaaugaagugaaaaagt

SEQ ID NO: 1162 - DNA, 25 bp, Artificial Sequence
  Description of Artificial Sequence: Synthetic oligonucleotide
  Description of Combined DNA/RNA Molecule: Synthetic oligonucleotide
uuuaaacaaugaagugaaaaagutt

SEQ ID NO: 1163 - DNA, 25 bp, Artificial Sequence
  Description of Artificial Sequence: Synthetic oligonucleotide
  Description of Combined DNA/RNA Molecule: Synthetic oligonucleotide
uuaaacaaugaagugaaaaaguutt

SEQ ID NO: 1164 - DNA, 25 bp, Artificial Sequence
  Description of Artificial Sequence: Synthetic oligonucleotide
  Description of Combined DNA/RNA Molecule: Synthetic oligonucleotide
uaaacaaugaagugaaaaaguuuta

SEQ ID NO: 1165 - DNA, 25 bp, Artificial Sequence
  Description of Artificial Sequence: Synthetic oligonucleotide
  Description of Combined DNA/RNA Molecule: Synthetic oligonucleotide
gaagugaaaaaguuuuacaaucuct

SEQ ID NO: 1166 - DNA, 25 bp, Artificial Sequence
  Description of Artificial Sequence: Synthetic oligonucleotide
  Description of Combined DNA/RNA Molecule: Synthetic oligonucleotide
aaaaaguuuuacaaucucuaggutt

SEQ ID NO: 1167 - DNA, 25 bp, Artificial Sequence
  Description of Artificial Sequence: Synthetic oligonucleotide
  Description of Combined DNA/RNA Molecule: Synthetic oligonucleotide
aaaaguuuuacaaucucuagguutg

SEQ ID NO: 1168 - RNA, 25 nt, Artificial Sequence
  Description of Artificial Sequence: Synthetic oligonucleotide
aaaguuuuacaaucucuagguuugg

SEQ ID NO: 1169 - RNA, 25 nt, Artificial Sequence
  Description of Artificial Sequence: Synthetic oligonucleotide
ugguuaaauuaacauugcauaaaca

SEQ ID NO: 1170 - RNA, 25 nt, Artificial Sequence
  Description of Artificial Sequence: Synthetic oligonucleotide
gguuaaauuaacauugcauaaacac

SEQ ID NO: 1171 - DNA, 25 bp, Artificial Sequence
  Description of Artificial Sequence: Synthetic oligonucleotide
  Description of Combined DNA/RNA Molecule: Synthetic oligonucleotide
guuaaauuaacauugcauaaacact

SEQ ID NO: 1172 - DNA, 25 bp, Artificial Sequence
  Description of Artificial Sequence: Synthetic oligonucleotide
  Description of Combined DNA/RNA Molecule: Synthetic oligonucleotide
auugcauaaacacuuuucaaguctg

SEQ ID NO: 1173 - RNA, 25 nt, Artificial Sequence
  Description of Artificial Sequence: Synthetic oligonucleotide
aagucugauccauauuuaauaaugc

SEQ ID NO: 1174 - RNA, 25 nt, Artificial Sequence
  Description of Artificial Sequence: Synthetic oligonucleotide
cauauuuaauaaugcuuuaaaauaa

SEQ ID NO: 1175 - RNA, 25 nt, Artificial Sequence
  Description of Artificial Sequence: Synthetic oligonucleotide
auauuuaauaaugcuuuaaaauaaa

SEQ ID NO: 1176 - RNA, 25 nt, Artificial Sequence
  Description of Artificial Sequence: Synthetic oligonucleotide
uauuuaauaaugcuuuaaaauaaaa

SEQ ID NO: 1177 - RNA, 25 nt, Artificial Sequence
  Description of Artificial Sequence: Synthetic oligonucleotide
auuuaauaaugcuuuaaaauaaaaa

SEQ ID NO: 1178 - DNA, 25 bp, Artificial Sequence
  Description of Artificial Sequence: Synthetic oligonucleotide
  Description of Combined DNA/RNA Molecule: Synthetic oligonucleotide
uuuaauaaugcuuuaaaauaaaaat

SEQ ID NO: 1179 - DNA, 25 bp, Artificial Sequence
  Description of Artificial Sequence: Synthetic oligonucleotide
  Description of Combined DNA/RNA Molecule: Synthetic oligonucleotide
uuaauaaugcuuuaaaauaaaaata

SEQ ID NO: 1180 - RNA, 25 nt, Artificial Sequence
  Description of Artificial Sequence: Synthetic oligonucleotide
aauaaugcuuuaaaauaaaaauaaa

SEQ ID NO: 1181 - RNA, 25 nt, Artificial Sequence
  Description of Artificial Sequence: Synthetic oligonucleotide
auaaugcuuuaaaauaaaaauaaaa

SEQ ID NO: 1182 - RNA, 25 nt, Artificial Sequence
  Description of Artificial Sequence: Synthetic oligonucleotide
uaaugcuuuaaaauaaaaauaaaaa

SEQ ID NO: 1183 - RNA, 25 nt, Artificial Sequence
  Description of Artificial Sequence: Synthetic oligonucleotide
aaugcuuuaaaauaaaaauaaaaac

SEQ ID NO: 1184 - DNA, 25 bp, Artificial Sequence
  Description of Artificial Sequence: Synthetic oligonucleotide
  Description of Combined DNA/RNA Molecule: Synthetic oligonucleotide
uaaaauaaaaauaaaaacaaucctt

SEQ ID NO: 1185 - DNA, 25 bp, Artificial Sequence
  Description of Artificial Sequence: Synthetic oligonucleotide
  Description of Combined DNA/RNA Molecule: Synthetic oligonucleotide
aaaaauaaaaacaauccuuuugata

SEQ ID NO: 1186 - RNA, 25 nt, Artificial Sequence
  Description of Artificial Sequence: Synthetic oligonucleotide
aaaauaaaaacaauccuuuugauaa

SEQ ID NO: 1187 - RNA, 25 nt, Artificial Sequence
  Description of Artificial Sequence: Synthetic oligonucleotide
aaauaaaaacaauccuuuugauaaa

SEQ ID NO: 1188 - DNA, 25 bp, Artificial Sequence
  Description of Artificial Sequence: Synthetic oligonucleotide
  Description of Combined DNA/RNA Molecule: Synthetic oligonucleotide
aauaaaaacaauccuuuugauaaat

SEQ ID NO: 1189 - DNA, 25 bp, Artificial Sequence
  Description of Artificial Sequence: Synthetic oligonucleotide
  Description of Combined DNA/RNA Molecule: Synthetic oligonucleotide
auaaaaacaauccuuuugauaaatt

SEQ ID NO: 1190 - DNA, 25 bp, Artificial Sequence
  Description of Artificial Sequence: Synthetic oligonucleotide
  Description of Combined DNA/RNA Molecule: Synthetic oligonucleotide
uaaaaacaauccuuuugauaaautt

SEQ ID NO: 1191 - DNA, 25 bp, Artificial Sequence
  Description of Artificial Sequence: Synthetic oligonucleotide
  Description of Combined DNA/RNA Molecule: Synthetic oligonucleotide
aaaaacaauccuuuugauaaauuta

SEQ ID NO: 1192 - RNA, 25 nt, Artificial Sequence
  Description of Artificial Sequence: Synthetic oligonucleotide
aaaacaauccuuuugauaaauuuaa

SEQ ID NO: 1193 - DNA, 25 bp, Artificial Sequence
  Description of Artificial Sequence: Synthetic oligonucleotide
  Description of Combined DNA/RNA Molecule: Synthetic oligonucleotide
caauccuuuugauaaauuuaaaatg

SEQ ID NO: 1194 - DNA, 25 bp, Artificial Sequence
  Description of Artificial Sequence: Synthetic oligonucleotide
  Description of Combined DNA/RNA Molecule: Synthetic oligonucleotide
cuuuugauaaauuuaaaauguuact

SEQ ID NO: 1195 - DNA, 25 bp, Artificial Sequence
  Description of Artificial Sequence: Synthetic oligonucleotide
  Description of Combined DNA/RNA Molecule: Synthetic oligonucleotide
uuuugauaaauuuaaaauguuactt

SEQ ID NO: 1196 - DNA, 25 bp, Artificial Sequence
  Description of Artificial Sequence: Synthetic oligonucleotide
  Description of Combined DNA/RNA Molecule: Synthetic oligonucleotide
uuugauaaauuuaaaauguuacuta

SEQ ID NO: 1197 - DNA, 25 bp, Artificial Sequence
  Description of Artificial Sequence: Synthetic oligonucleotide
  Description of Combined DNA/RNA Molecule: Synthetic oligonucleotide
auaaauuuaaaauguuacuuauutt

SEQ ID NO: 1198 - DNA, 25 bp, Artificial Sequence
  Description of Artificial Sequence: Synthetic oligonucleotide
  Description of Combined DNA/RNA Molecule: Synthetic oligonucleotide
uaaauuuaaaauguuacuuauuuta

SEQ ID NO: 1199 - RNA, 25 nt, Artificial Sequence
  Description of Artificial Sequence: Synthetic oligonucleotide
aaauuuaaaauguuacuuauuuuaa

SEQ ID NO: 1200 - RNA, 25 nt, Artificial Sequence
  Description of Artificial Sequence: Synthetic oligonucleotide
aauuuaaaauguuacuuauuuuaaa

SEQ ID NO: 1201 - RNA, 25 nt, Artificial Sequence
  Description of Artificial Sequence: Synthetic oligonucleotide
auuuaaaauguuacuuauuuuaaaa

SEQ ID NO: 1202 - DNA, 25 bp, Artificial Sequence
  Description of Artificial Sequence: Synthetic oligonucleotide
  Description of Combined DNA/RNA Molecule: Synthetic oligonucleotide
uuuaaaauguuacuuauuuuaaaat

SEQ ID NO: 1203 - RNA, 25 nt, Artificial Sequence
  Description of Artificial Sequence: Synthetic oligonucleotide
uaaaauguuacuuauuuuaaaauaa

SEQ ID NO: 1204 - RNA, 25 nt, Artificial Sequence
  Description of Artificial Sequence: Synthetic oligonucleotide
aaaauguuacuuauuuuaaaauaaa

SEQ ID NO: 1205 - DNA, 25 bp, Artificial Sequence
  Description of Artificial Sequence: Synthetic oligonucleotide
  Description of Combined DNA/RNA Molecule: Synthetic oligonucleotide
aaauguuacuuauuuuaaaauaaat

SEQ ID NO: 1206 - DNA, 25 bp, Artificial Sequence
  Description of Artificial Sequence: Synthetic oligonucleotide
  Description of Combined DNA/RNA Molecule: Synthetic oligonucleotide
aauguuacuuauuuuaaaauaaatg

SEQ ID NO: 1207 - RNA, 25 nt, Artificial Sequence
  Description of Artificial Sequence: Synthetic oligonucleotide
auguuacuuauuuuaaaauaaauga

SEQ ID NO: 1208 - RNA, 25 nt, Artificial Sequence
  Description of Artificial Sequence: Synthetic oligonucleotide
guuacuuauuuuaaaauaaaugaag

SEQ ID NO: 1209 - RNA, 25 nt, Artificial Sequence
  Description of Artificial Sequence: Synthetic oligonucleotide
uuauuuuaaaauaaaugaagugaga

SEQ ID NO: 1210 - DNA, 25 bp, Artificial Sequence
  Description of Artificial Sequence: Synthetic oligonucleotide
  Description of Combined DNA/RNA Molecule: Synthetic oligonucleotide
auuuuaaaauaaaugaagugagatg

SEQ ID NO: 1211 - RNA, 25 nt, Artificial Sequence
  Description of Artificial Sequence: Synthetic oligonucleotide
uuuuaaaauaaaugaagugagaugg

SEQ ID NO: 1212 - DNA, 25 bp, Artificial Sequence
  Description of Artificial Sequence: Synthetic oligonucleotide
  Description of Combined DNA/RNA Molecule: Synthetic oligonucleotide
uaaaauaaaugaagugagauggcat

SEQ ID NO: 1213 - DNA, 25 bp, Artificial Sequence
  Description of Artificial Sequence: Synthetic oligonucleotide
  Description of Combined DNA/RNA Molecule: Synthetic oligonucleotide
aaaauaaaugaagugagauggcatg

SEQ ID NO: 1214 - RNA, 25 nt, Artificial Sequence
  Description of Artificial Sequence: Synthetic oligonucleotide
cauuucuucauguuaaaagaaguca

SEQ ID NO: 1215 - DNA, 25 bp, Artificial Sequence
  Description of Artificial Sequence: Synthetic oligonucleotide
  Description of Combined DNA/RNA Molecule: Synthetic oligonucleotide
auuucuucauguuaaaagaagucat

SEQ ID NO: 1216 - RNA, 25 nt, Artificial Sequence
  Description of Artificial Sequence: Synthetic oligonucleotide
caaacucuuaguuuuuuuuuuuuac

SEQ ID NO: 1217 - RNA, 25 nt, Artificial Sequence
  Description of Artificial Sequence: Synthetic oligonucleotide
guuuuuuuuuuuuacaacuauguaa

SEQ ID NO: 1218 - DNA, 25 bp, Artificial Sequence
  Description of Artificial Sequence: Synthetic oligonucleotide
  Description of Combined DNA/RNA Molecule: Synthetic oligonucleotide
uuuuuuuuuuuuacaacuauguaat

SEQ ID NO: 1219 - DNA, 25 bp, Artificial Sequence
  Description of Artificial Sequence: Synthetic oligonucleotide
  Description of Combined DNA/RNA Molecule: Synthetic oligonucleotide
uuuuuuuuuuuacaacuauguaatt

SEQ ID NO: 1220 - DNA, 25 bp, Artificial Sequence
  Description of Artificial Sequence: Synthetic oligonucleotide
  Description of Combined DNA/RNA Molecule: Synthetic oligonucleotide
uuuuuuuuuuacaacuauguaautt

SEQ ID NO: 1221 - DNA, 25 bp, Artificial Sequence
  Description of Artificial Sequence: Synthetic oligonucleotide
  Description of Combined DNA/RNA Molecule: Synthetic oligonucleotide
uuuuuuuuuacaacuauguaauuta

SEQ ID NO: 1222 - DNA, 25 bp, Artificial Sequence
  Description of Artificial Sequence: Synthetic oligonucleotide
  Description of Combined DNA/RNA Molecule: Synthetic oligonucleotide
uuuuuuuuacaacuauguaauuuat

SEQ ID NO: 1223 - DNA, 25 bp, Artificial Sequence
  Description of Artificial Sequence: Synthetic oligonucleotide
  Description of Combined DNA/RNA Molecule: Synthetic oligonucleotide
uuuuuuuacaacuauguaauuuata

SEQ ID NO: 1224 - DNA, 25 bp, Artificial Sequence
  Description of Artificial Sequence: Synthetic oligonucleotide
  Description of Combined DNA/RNA Molecule: Synthetic oligonucleotide
uuuuuuacaacuauguaauuuauat

SEQ ID NO: 1225 - DNA, 25 bp, Artificial Sequence
  Description of Artificial Sequence: Synthetic oligonucleotide
  Description of Combined DNA/RNA Molecule: Synthetic oligonucleotide
uuuuuacaacuauguaauuuauatt

SEQ ID NO: 1226 - DNA, 25 bp, Artificial Sequence
  Description of Artificial Sequence: Synthetic oligonucleotide
  Description of Combined DNA/RNA Molecule: Synthetic oligonucleotide
uuuuacaacuauguaauuuauautc

SEQ ID NO: 1227 - RNA, 25 nt, Artificial Sequence
  Description of Artificial Sequence: Synthetic oligonucleotide
uuuacaacuauguaauuuauauucc

SEQ ID NO: 1228 - RNA, 25 nt, Artificial Sequence
  Description of Artificial Sequence: Synthetic oligonucleotide
cuauguaauuuauauuccauuuaca

SEQ ID NO: 1229 - DNA, 25 bp, Artificial Sequence
  Description of Artificial Sequence: Synthetic oligonucleotide
  Description of Combined DNA/RNA Molecule: Synthetic oligonucleotide
uauguaauuuauauuccauuuacat

SEQ ID NO: 1230 - DNA, 25 bp, Artificial Sequence
  Description of Artificial Sequence: Synthetic oligonucleotide
  Description of Combined DNA/RNA Molecule: Synthetic oligonucleotide
auguaauuuauauuccauuuacata

SEQ ID NO: 1231 - DNA, 25 bp, Artificial Sequence
  Description of Artificial Sequence: Synthetic oligonucleotide
  Description of Combined DNA/RNA Molecule: Synthetic oligonucleotide
uuuauauuccauuuacauaaggata

SEQ ID NO: 1232 - RNA, 25 nt, Artificial Sequence
  Description of Artificial Sequence: Synthetic oligonucleotide
uuauauuccauuuacauaaggauac

SEQ ID NO: 1233 - RNA, 25 nt, Artificial Sequence
  Description of Artificial Sequence: Synthetic oligonucleotide
uauauuccauuuacauaaggauaca

SEQ ID NO: 1234 - RNA, 25 nt, Artificial Sequence
  Description of Artificial Sequence: Synthetic oligonucleotide
auauuccauuuacauaaggauacac

SEQ ID NO: 1235 - RNA, 25 nt, Artificial Sequence
  Description of Artificial Sequence: Synthetic oligonucleotide
cauaaggauacacuuauuugucaag

SEQ ID NO: 1236 - RNA, 25 nt, Artificial Sequence
  Description of Artificial Sequence: Synthetic oligonucleotide
aggauacacuuauuugucaagcuca

SEQ ID NO: 1237 - RNA, 25 nt, Artificial Sequence
  Description of Artificial Sequence: Synthetic oligonucleotide
cuguaaauuuuuaaccuauguuaca

SEQ ID NO: 1238 - RNA, 25 nt, Artificial Sequence
  Description of Artificial Sequence: Synthetic oligonucleotide
uguaaauuuuuaaccuauguuacac

SEQ ID NO: 1239 - RNA, 25 nt, Artificial Sequence
  Description of Artificial Sequence: Synthetic oligonucleotide
guaaauuuuuaaccuauguuacacc

SEQ ID NO: 1240 - DNA, 25 bp, Artificial Sequence
  Description of Artificial Sequence: Synthetic oligonucleotide
  Description of Combined DNA/RNA Molecule: Synthetic oligonucleotide
caagaggugaaguuuauauuugaat

SEQ ID NO: 1241 - DNA, 25 bp, Artificial Sequence
  Description of Artificial Sequence: Synthetic oligonucleotide
  Description of Combined DNA/RNA Molecule: Synthetic oligonucleotide
agaggugaaguuuauauuugaauat

SEQ ID NO: 1242 - DNA, 25 bp, Artificial Sequence
  Description of Artificial Sequence: Synthetic oligonucleotide
  Description of Combined DNA/RNA Molecule: Synthetic oligonucleotide
gaggugaaguuuauauuugaauatc

SEQ ID NO: 1243 - RNA, 25 nt, Artificial Sequence
  Description of Artificial Sequence: Synthetic oligonucleotide
ggugaaguuuauauuugaauaucca

SEQ ID NO: 1244 - DNA, 25 bp, Artificial Sequence
  Description of Artificial Sequence: Synthetic oligonucleotide
  Description of Combined DNA/RNA Molecule: Synthetic oligonucleotide
gugaaguuuauauuugaauauccat

SEQ ID NO: 1245 - RNA, 25 nt, Artificial Sequence
  Description of Artificial Sequence: Synthetic oligonucleotide
guuuauauuugaauauccauucucg

SEQ ID NO: 1246 - DNA, 25 bp, Artificial Sequence
  Description of Artificial Sequence: Synthetic oligonucleotide
  Description of Combined DNA/RNA Molecule: Synthetic oligonucleotide
uugaugcaguuuuaauacuuguaat

SEQ ID NO: 1247 - DNA, 25 bp, Artificial Sequence
  Description of Artificial Sequence: Synthetic oligonucleotide
  Description of Combined DNA/RNA Molecule: Synthetic oligonucleotide
gaugcaguuuuaauacuuguaautc

SEQ ID NO: 1248 - RNA, 25 nt, Artificial Sequence
  Description of Artificial Sequence: Synthetic oligonucleotide
uuugaccuaaucacuaauuuucagg

SEQ ID NO: 1249 - RNA, 25 nt, Artificial Sequence
  Description of Artificial Sequence: Synthetic oligonucleotide
cuaaucacuaauuuucagguggugg

SEQ ID NO: 1250 - RNA, 25 nt, Artificial Sequence
  Description of Artificial Sequence: Synthetic oligonucleotide
guaggauuuuucaaaccugguauga

SEQ ID NO: 1251 - RNA, 25 nt, Artificial Sequence
  Description of Artificial Sequence: Synthetic oligonucleotide
uggaaggagaauuuaauaaagauag

SEQ ID NO: 1252 - RNA, 25 nt, Artificial Sequence
  Description of Artificial Sequence: Synthetic oligonucleotide
aaggagaauuuaauaaagauagugc

SEQ ID NO: 1253 - DNA, 25 bp, Artificial Sequence
  Description of Artificial Sequence: Synthetic oligonucleotide
  Description of Combined DNA/RNA Molecule: Synthetic oligonucleotide
ggagaauuuaauaaagauagugctg

SEQ ID NO: 1254 - RNA, 25 nt, Artificial Sequence
  Description of Artificial Sequence: Synthetic oligonucleotide
gagaauuuaauaaagauagugcuga

SEQ ID NO: 1255 - RNA, 25 nt, Artificial Sequence
  Description of Artificial Sequence: Synthetic oligonucleotide
auuuaauaaagauagugcugaaaga

SEQ ID NO: 1256 - DNA, 25 bp, Artificial Sequence
  Description of Artificial Sequence: Synthetic oligonucleotide
  Description of Combined DNA/RNA Molecule: Synthetic oligonucleotide
cuuagguaaucuauaacuaggacta

SEQ ID NO: 1257 - RNA, 25 nt, Artificial Sequence
  Description of Artificial Sequence: Synthetic oligonucleotide
uuagguaaucuauaacuaggacuac

SEQ ID NO: 1258 - DNA, 25 bp, Artificial Sequence
  Description of Artificial Sequence: Synthetic oligonucleotide
  Description of Combined DNA/RNA Molecule: Synthetic oligonucleotide
caguaauacauuccauuguuuuagt

SEQ ID NO: 1259 - RNA, 25 nt, Artificial Sequence
  Description of Artificial Sequence: Synthetic oligonucleotide
guaauacauuccauuguuuuaguaa

SEQ ID NO: 1260 - RNA, 25 nt, Artificial Sequence
  Description of Artificial Sequence: Synthetic oligonucleotide
uaauacauuccauuguuuuaguaac

SEQ ID NO: 1261 - RNA, 25 nt, Artificial Sequence
  Description of Artificial Sequence: Synthetic oligonucleotide
aauacauuccauuguuuuaguaacc

SEQ ID NO: 1262 - DNA, 25 bp, Artificial Sequence
  Description of Artificial Sequence: Synthetic oligonucleotide
  Description of Combined DNA/RNA Molecule: Synthetic oligonucleotide
auuguuuuaguaaccagaaaucutc

SEQ ID NO: 1263 - DNA, 25 bp, Artificial Sequence
  Description of Artificial Sequence: Synthetic oligonucleotide
  Description of Combined DNA/RNA Molecule: Synthetic oligonucleotide
cagaaaucuucaugcaaugaaaaat

SEQ ID NO: 1264 - DNA, 25 bp, Artificial Sequence
  Description of Artificial Sequence: Synthetic oligonucleotide
  Description of Combined DNA/RNA Molecule: Synthetic oligonucleotide
caugcaaugaaaaauacuuuaautc

SEQ ID NO: 1265 - RNA, 25 nt, Artificial Sequence
  Description of Artificial Sequence: Synthetic oligonucleotide
ugaaaaauacuuuaauucaugaagc

SEQ ID NO: 1266 - DNA, 25 bp, Artificial Sequence
  Description of Artificial Sequence: Synthetic oligonucleotide
  Description of Combined DNA/RNA Molecule: Synthetic oligonucleotide
aaaaauacuuuaauucaugaagctt

SEQ ID NO: 1267 - DNA, 25 bp, Artificial Sequence
  Description of Artificial Sequence: Synthetic oligonucleotide
  Description of Combined DNA/RNA Molecule: Synthetic oligonucleotide
aaaauacuuuaauucaugaagcuta

SEQ ID NO: 1268 - RNA, 25 nt, Artificial Sequence
  Description of Artificial Sequence: Synthetic oligonucleotide
caugaagcuuacuuuuuuuuuuugg

SEQ ID NO: 1269 - DNA, 25 bp, Artificial Sequence
  Description of Artificial Sequence: Synthetic oligonucleotide
  Description of Combined DNA/RNA Molecule: Synthetic oligonucleotide
gaagcuuacuuuuuuuuuuuggugt

SEQ ID NO: 1270 - RNA, 25 nt, Artificial Sequence
  Description of Artificial Sequence: Synthetic oligonucleotide
cuuacuuuuuuuuuuuggugucaga

SEQ ID NO: 1271 - DNA, 25 bp, Artificial Sequence
  Description of Artificial Sequence: Synthetic oligonucleotide
  Description of Combined DNA/RNA Molecule: Synthetic oligonucleotide
cuuuuuuuuuuuggugucagaguct

SEQ ID NO: 1272 - DNA, 25 bp, Artificial Sequence
  Description of Artificial Sequence: Synthetic oligonucleotide
  Description of Combined DNA/RNA Molecule: Synthetic oligonucleotide
uuuuuuuuuuuggugucagaguctc

SEQ ID NO: 1273 - RNA, 25 nt, Artificial Sequence
  Description of Artificial Sequence: Synthetic oligonucleotide
cuaauuuuuguauuuuuaggagaga

SEQ ID NO: 1274 - RNA, 25 nt, Artificial Sequence
  Description of Artificial Sequence: Synthetic oligonucleotide
auuuuuguauuuuuaggagagacgg

SEQ ID NO: 1275 - RNA, 25 nt, Artificial Sequence
  Description of Artificial Sequence: Synthetic oligonucleotide
cauuuauucagcaaauauuuauuga

SEQ ID NO: 1276 - DNA, 25 bp, Artificial Sequence
  Description of Artificial Sequence: Synthetic oligonucleotide
  Description of Combined DNA/RNA Molecule: Synthetic oligonucleotide
uuuauucagcaaauauuuauugagt

SEQ ID NO: 1277 - RNA, 25 nt, Artificial Sequence
  Description of Artificial Sequence: Synthetic oligonucleotide
uauucagcaaauauuuauugagugc

SEQ ID NO: 1278 - DNA, 25 bp, Artificial Sequence
  Description of Artificial Sequence: Synthetic oligonucleotide
  Description of Combined DNA/RNA Molecule: Synthetic oligonucleotide
uuuuaguuuugcaaagaaggggutt

SEQ ID NO: 1279 - RNA, 25 nt, Artificial Sequence
  Description of Artificial Sequence: Synthetic oligonucleotide
cuauaauuguuuugcuacgauucca

SEQ ID NO: 1280 - DNA, 25 bp, Artificial Sequence
  Description of Artificial Sequence: Synthetic oligonucleotide
  Description of Combined DNA/RNA Molecule: Synthetic oligonucleotide
cuuuauguaaaucacuucauugutt

SEQ ID NO: 1281 - DNA, 25 bp, Artificial Sequence
  Description of Artificial Sequence: Synthetic oligonucleotide
  Description of Combined DNA/RNA Molecule: Synthetic oligonucleotide
uuuauguaaaucacuucauuguutt

SEQ ID NO: 1282 - DNA, 25 bp, Artificial Sequence
  Description of Artificial Sequence: Synthetic oligonucleotide
  Description of Combined DNA/RNA Molecule: Synthetic oligonucleotide
uuauguaaaucacuucauuguuuta

SEQ ID NO: 1283 - RNA, 25 nt, Artificial Sequence
  Description of Artificial Sequence: Synthetic oligonucleotide
uauguaaaucacuucauuguuuuaa

SEQ ID NO: 1284 - RNA, 25 nt, Artificial Sequence
  Description of Artificial Sequence: Synthetic oligonucleotide
auguaaaucacuucauuguuuuaaa

SEQ ID NO: 1285 - RNA, 25 nt, Artificial Sequence
  Description of Artificial Sequence: Synthetic oligonucleotide
uguaaaucacuucauuguuuuaaag

SEQ ID NO: 1286 - RNA, 25 nt, Artificial Sequence
  Description of Artificial Sequence: Synthetic oligonucleotide
guaaaucacuucauuguuuuaaagg

SEQ ID NO: 1287 - DNA, 25 bp, Artificial Sequence
  Description of Artificial Sequence: Synthetic oligonucleotide
  Description of Combined DNA/RNA Molecule: Synthetic oligonucleotide
uguuuuaaaggaauaaacuugauta

SEQ ID NO: 1288 - DNA, 25 bp, Artificial Sequence
  Description of Artificial Sequence: Synthetic oligonucleotide
  Description of Combined DNA/RNA Molecule: Synthetic oligonucleotide
guuuuaaaggaauaaacuugauuat

SEQ ID NO: 1289 - DNA, 25 bp, Artificial Sequence
  Description of Artificial Sequence: Synthetic oligonucleotide
  Description of Combined DNA/RNA Molecule: Synthetic oligonucleotide
uuaaaggaauaaacuugauuauatt

SEQ ID NO: 1290 - DNA, 25 bp, Artificial Sequence
  Description of Artificial Sequence: Synthetic oligonucleotide
  Description of Combined DNA/RNA Molecule: Synthetic oligonucleotide
uaaaggaauaaacuugauuauautg

SEQ ID NO: 1291 - DNA, 25 bp, Artificial Sequence
  Description of Artificial Sequence: Synthetic oligonucleotide
  Description of Combined DNA/RNA Molecule: Synthetic oligonucleotide
aaaggaauaaacuugauuauauugt

SEQ ID NO: 1292 - DNA, 25 bp, Artificial Sequence
  Description of Artificial Sequence: Synthetic oligonucleotide
  Description of Combined DNA/RNA Molecule: Synthetic oligonucleotide
aggaauaaacuugauuauauugutt

SEQ ID NO: 1293 - DNA, 25 bp, Artificial Sequence
  Description of Artificial Sequence: Synthetic oligonucleotide
  Description of Combined DNA/RNA Molecule: Synthetic oligonucleotide
ggaauaaacuugauuauauuguutt

SEQ ID NO: 1294 - DNA, 25 bp, Artificial Sequence
  Description of Artificial Sequence: Synthetic oligonucleotide
  Description of Combined DNA/RNA Molecule: Synthetic oligonucleotide
gaauaaacuugauuauauuguuutt

SEQ ID NO: 1295 - DNA, 25 bp, Artificial Sequence
  Description of Artificial Sequence: Synthetic oligonucleotide
  Description of Combined DNA/RNA Molecule: Synthetic oligonucleotide
aauaaacuugauuauauuguuuutt

SEQ ID NO: 1296 - DNA, 25 bp, Artificial Sequence
  Description of Artificial Sequence: Synthetic oligonucleotide
  Description of Combined DNA/RNA Molecule: Synthetic oligonucleotide
auaaacuugauuauauuguuuuutt

SEQ ID NO: 1297 - DNA, 25 bp, Artificial Sequence
  Description of Artificial Sequence: Synthetic oligonucleotide
  Description of Combined DNA/RNA Molecule: Synthetic oligonucleotide
cuugauuauauuguuuuuuuauutg

SEQ ID NO: 1298 - RNA, 25 nt, Artificial Sequence
  Description of Artificial Sequence: Synthetic oligonucleotide
uugauuauauuguuuuuuuauuugg

SEQ ID NO: 1299 - DNA, 25 bp, Artificial Sequence
  Description of Artificial Sequence: Synthetic oligonucleotide
  Description of Combined DNA/RNA Molecule: Synthetic oligonucleotide
auuauauuguuuuuuuauuuggcat

SEQ ID NO: 1300 - DNA, 25 bp, Artificial Sequence
  Description of Artificial Sequence: Synthetic oligonucleotide
  Description of Combined DNA/RNA Molecule: Synthetic oligonucleotide
auuguuuuuuuauuuggcauaactg

SEQ ID NO: 1301 - DNA, 25 bp, Artificial Sequence
  Description of Artificial Sequence: Synthetic oligonucleotide
  Description of Combined DNA/RNA Molecule: Synthetic oligonucleotide
uuguuuuuuuauuuggcauaacugt

SEQ ID NO: 1302 - DNA, 25 bp, Artificial Sequence
  Description of Artificial Sequence: Synthetic oligonucleotide
  Description of Combined DNA/RNA Molecule: Synthetic oligonucleotide
uuuuuuauuuggcauaacugugatt

SEQ ID NO: 1303 - DNA, 25 bp, Artificial Sequence
  Description of Artificial Sequence: Synthetic oligonucleotide
  Description of Combined DNA/RNA Molecule: Synthetic oligonucleotide
uuuuuauuuggcauaacugugautc

SEQ ID NO: 1304 - DNA, 25 bp, Artificial Sequence
  Description of Artificial Sequence: Synthetic oligonucleotide
  Description of Combined DNA/RNA Molecule: Synthetic oligonucleotide
auaacugugauucuuuuaggacaat

SEQ ID NO: 1305 - DNA, 25 bp, Artificial Sequence
  Description of Artificial Sequence: Synthetic oligonucleotide
  Description of Combined DNA/RNA Molecule: Synthetic oligonucleotide
ugugauucuuuuaggacaauuactg

SEQ ID NO: 1306 - DNA, 25 bp, Artificial Sequence
  Description of Artificial Sequence: Synthetic oligonucleotide
  Description of Combined DNA/RNA Molecule: Synthetic oligonucleotide
gugauucuuuuaggacaauuacugt

SEQ ID NO: 1307 - RNA, 25 nt, Artificial Sequence
  Description of Artificial Sequence: Synthetic oligonucleotide
uguaugucagauauucauauugacc

SEQ ID NO: 1308 - RNA, 25 nt, Artificial Sequence
  Description of Artificial Sequence: Synthetic oligonucleotide
guaugucagauauucauauugaccc

SEQ ID NO: 1309 - DNA, 25 bp, Artificial Sequence
  Description of Artificial Sequence: Synthetic oligonucleotide
  Description of Combined DNA/RNA Molecule: Synthetic oligonucleotide
aauguguaauauuccaguuuucuct

SEQ ID NO: 1310 - RNA, 25 nt, Artificial Sequence
  Description of Artificial Sequence: Synthetic oligonucleotide
uaaguaauuaaaauauacuuaaaaa

SEQ ID NO: 1311 - DNA, 25 bp, Artificial Sequence
  Description of Artificial Sequence: Synthetic oligonucleotide
  Description of Combined DNA/RNA Molecule: Synthetic oligonucleotide
aaguaauuaaaauauacuuaaaaat

SEQ ID NO: 1312 - DNA, 25 bp, Artificial Sequence
  Description of Artificial Sequence: Synthetic oligonucleotide
  Description of Combined DNA/RNA Molecule: Synthetic oligonucleotide
aguaauuaaaauauacuuaaaaatt

SEQ ID NO: 1313 - DNA, 25 bp, Artificial Sequence
  Description of Artificial Sequence: Synthetic oligonucleotide
  Description of Combined DNA/RNA Molecule: Synthetic oligonucleotide
guaauuaaaauauacuuaaaaauta

SEQ ID NO: 1314 - RNA, 25 nt, Artificial Sequence
  Description of Artificial Sequence: Synthetic oligonucleotide
uaauuaaaauauacuuaaaaauuaa

SEQ ID NO: 1315 - DNA, 25 bp, Artificial Sequence
  Description of Artificial Sequence: Synthetic oligonucleotide
  Description of Combined DNA/RNA Molecule: Synthetic oligonucleotide
aauuaaaauauacuuaaaaauuaat

SEQ ID NO: 1316 - DNA, 25 bp, Artificial Sequence
  Description of Artificial Sequence: Synthetic oligonucleotide
  Description of Combined DNA/RNA Molecule: Synthetic oligonucleotide
auuaaaauauacuuaaaaauuaata

SEQ ID NO: 1317 - RNA, 25 nt, Artificial Sequence
  Description of Artificial Sequence: Synthetic oligonucleotide
uuaaaauauacuuaaaaauuaauag

SEQ ID NO: 1318 - DNA, 25 bp, Artificial Sequence
  Description of Artificial Sequence: Synthetic oligonucleotide
  Description of Combined DNA/RNA Molecule: Synthetic oligonucleotide
uaaaauauacuuaaaaauuaauagt

SEQ ID NO: 1319 - DNA, 25 bp, Artificial Sequence
  Description of Artificial Sequence: Synthetic oligonucleotide
  Description of Combined DNA/RNA Molecule: Synthetic oligonucleotide
aaauauacuuaaaaauuaauagutt

SEQ ID NO: 1320 - DNA, 25 bp, Artificial Sequence
  Description of Artificial Sequence: Synthetic oligonucleotide
  Description of Combined DNA/RNA Molecule: Synthetic oligonucleotide
aauauacuuaaaaauuaauaguutt

SEQ ID NO: 1321 - DNA, 25 bp, Artificial Sequence
  Description of Artificial Sequence: Synthetic oligonucleotide
  Description of Combined DNA/RNA Molecule: Synthetic oligonucleotide
auauacuuaaaaauuaauaguuuta

SEQ ID NO: 1322 - DNA, 25 bp, Artificial Sequence
  Description of Artificial Sequence: Synthetic oligonucleotide
  Description of Combined DNA/RNA Molecule: Synthetic oligonucleotide
uauacuuaaaaauuaauaguuuuat

SEQ ID NO: 1323 - RNA, 25 nt, Artificial Sequence
  Description of Artificial Sequence: Synthetic oligonucleotide
cuuaaaaauuaauaguuuuaucugg

SEQ ID NO: 1324 - RNA, 25 nt, Artificial Sequence
  Description of Artificial Sequence: Synthetic oligonucleotide
aaaauuaauaguuuuaucuggguac

SEQ ID NO: 1325 - RNA, 25 nt, Artificial Sequence
  Description of Artificial Sequence: Synthetic oligonucleotide
aaauuaauaguuuuaucuggguaca

SEQ ID NO: 1326 - RNA, 25 nt, Artificial Sequence
  Description of Artificial Sequence: Synthetic oligonucleotide
aauuaauaguuuuaucuggguacaa

SEQ ID NO: 1327 - DNA, 25 bp, Artificial Sequence
  Description of Artificial Sequence: Synthetic oligonucleotide
  Description of Combined DNA/RNA Molecule: Synthetic oligonucleotide
cuggguacaaauaaacaggugcctg

SEQ ID NO: 1328 - RNA, 25 nt, Artificial Sequence
  Description of Artificial Sequence: Synthetic oligonucleotide
caaggaaacuucuauguaaaaauca

SEQ ID NO: 1329 - RNA, 25 nt, Artificial Sequence
  Description of Artificial Sequence: Synthetic oligonucleotide
aaggaaacuucuauguaaaaaucac

SEQ ID NO: 1330 - DNA, 25 bp, Artificial Sequence
  Description of Artificial Sequence: Synthetic oligonucleotide
  Description of Combined DNA/RNA Molecule: Synthetic oligonucleotide
aggaaacuucuauguaaaaaucact

SEQ ID NO: 1331 - DNA, 25 bp, Artificial Sequence
  Description of Artificial Sequence: Synthetic oligonucleotide
  Description of Combined DNA/RNA Molecule: Synthetic oligonucleotide
cuauguaaaaaucacuaugauuuct

SEQ ID NO: 1332 - DNA, 25 bp, Artificial Sequence
  Description of Artificial Sequence: Synthetic oligonucleotide
  Description of Combined DNA/RNA Molecule: Synthetic oligonucleotide
uauguaaaaaucacuaugauuuctg

SEQ ID NO: 1333 - RNA, 25 nt, Artificial Sequence
  Description of Artificial Sequence: Synthetic oligonucleotide
auguaaaaaucacuaugauuucuga

SEQ ID NO: 1334 - DNA, 25 bp, Artificial Sequence
  Description of Artificial Sequence: Synthetic oligonucleotide
  Description of Combined DNA/RNA Molecule: Synthetic oligonucleotide
aaaaaucacuaugauuucugaautg

SEQ ID NO: 1335 - RNA, 25 nt, Artificial Sequence
  Description of Artificial Sequence: Synthetic oligonucleotide
aaaaucacuaugauuucugaauugc

SEQ ID NO: 1336 - RNA, 25 nt, Artificial Sequence
  Description of Artificial Sequence: Synthetic oligonucleotide
augauuucugaauugcuaugugaaa

SEQ ID NO: 1337 - RNA, 25 nt, Artificial Sequence
  Description of Artificial Sequence: Synthetic oligonucleotide
ugauuucugaauugcuaugugaaac

SEQ ID NO: 1338 - RNA, 25 nt, Artificial Sequence
  Description of Artificial Sequence: Synthetic oligonucleotide
ugugaaacuacagaucuuuggaaca

SEQ ID NO: 1339 - RNA, 25 nt, Artificial Sequence
  Description of Artificial Sequence: Synthetic oligonucleotide
gugaaacuacagaucuuuggaacac

SEQ ID NO: 1340 - DNA, 25 bp, Artificial Sequence
  Description of Artificial Sequence: Synthetic oligonucleotide
  Description of Combined DNA/RNA Molecule: Synthetic oligonucleotide
gguguuaagacuuacacaguacctc

SEQ ID NO: 1341 - RNA, 25 nt, Artificial Sequence
  Description of Artificial Sequence: Synthetic oligonucleotide
uaggccucuugaauuuuugauguag

SEQ ID NO: 1342 - DNA, 25 bp, Artificial Sequence
  Description of Artificial Sequence: Synthetic oligonucleotide
  Description of Combined DNA/RNA Molecule: Synthetic oligonucleotide
uugaauuuuugauguagaugggcat

SEQ ID NO: 1343 - DNA, 25 bp, Artificial Sequence
  Description of Artificial Sequence: Synthetic oligonucleotide
  Description of Combined DNA/RNA Molecule: Synthetic oligonucleotide
ugaauuuuugauguagaugggcatt

SEQ ID NO: 1344 - RNA, 25 nt, Artificial Sequence
  Description of Artificial Sequence: Synthetic oligonucleotide
gaugggcauuuuuuuaagguagugg

SEQ ID NO: 1345 - DNA, 25 bp, Artificial Sequence
  Description of Artificial Sequence: Synthetic oligonucleotide
  Description of Combined DNA/RNA Molecule: Synthetic oligonucleotide
cauuuuuuuaagguagugguuaatt

SEQ ID NO: 1346 - RNA, 25 nt, Artificial Sequence
  Description of Artificial Sequence: Synthetic oligonucleotide
guagugguuaauuaccuuuauguga

SEQ ID NO: 1347 - RNA, 25 nt, Artificial Sequence
  Description of Artificial Sequence: Synthetic oligonucleotide
agugguuaauuaccuuuaugugaac

SEQ ID NO: 1348 - DNA, 25 bp, Artificial Sequence
  Description of Artificial Sequence: Synthetic oligonucleotide
  Description of Combined DNA/RNA Molecule: Synthetic oligonucleotide
gugguuaauuaccuuuaugugaact

SEQ ID NO: 1349 - DNA, 25 bp, Artificial Sequence
  Description of Artificial Sequence: Synthetic oligonucleotide
  Description of Combined DNA/RNA Molecule: Synthetic oligonucleotide
ugguuaauuaccuuuaugugaactt

SEQ ID NO: 1350 - DNA, 25 bp, Artificial Sequence
  Description of Artificial Sequence: Synthetic oligonucleotide
  Description of Combined DNA/RNA Molecule: Synthetic oligonucleotide
gguuaauuaccuuuaugugaacutt

SEQ ID NO: 1351 - DNA, 25 bp, Artificial Sequence
  Description of Artificial Sequence: Synthetic oligonucleotide
  Description of Combined DNA/RNA Molecule: Synthetic oligonucleotide
cuuuaugugaacuuugaaugguuta

SEQ ID NO: 1352 - RNA, 25 nt, Artificial Sequence
  Description of Artificial Sequence: Synthetic oligonucleotide
ugugaacuuugaaugguuuaacaaa

SEQ ID NO: 1353 - DNA, 25 bp, Artificial Sequence
  Description of Artificial Sequence: Synthetic oligonucleotide
  Description of Combined DNA/RNA Molecule: Synthetic oligonucleotide
cuuugaaugguuuaacaaaagautt

SEQ ID NO: 1354 - DNA, 25 bp, Artificial Sequence
  Description of Artificial Sequence: Synthetic oligonucleotide
  Description of Combined DNA/RNA Molecule: Synthetic oligonucleotide
gaaugguuuaacaaaagauuugutt

SEQ ID NO: 1355 - DNA, 25 bp, Artificial Sequence
  Description of Artificial Sequence: Synthetic oligonucleotide
  Description of Combined DNA/RNA Molecule: Synthetic oligonucleotide
aaugguuuaacaaaagauuuguutt

SEQ ID NO: 1356 - DNA, 25 bp, Artificial Sequence
  Description of Artificial Sequence: Synthetic oligonucleotide
  Description of Combined DNA/RNA Molecule: Synthetic oligonucleotide
augguuuaacaaaagauuuguuutt

SEQ ID NO: 1357 - DNA, 25 bp, Artificial Sequence
  Description of Artificial Sequence: Synthetic oligonucleotide
  Description of Combined DNA/RNA Molecule: Synthetic oligonucleotide
ugguuuaacaaaagauuuguuuutg

SEQ ID NO: 1358 - DNA, 25 bp, Artificial Sequence
  Description of Artificial Sequence: Synthetic oligonucleotide
  Description of Combined DNA/RNA Molecule: Synthetic oligonucleotide
gguuuaacaaaagauuuguuuuugt

SEQ ID NO: 1359 - RNA, 25 nt, Artificial Sequence
  Description of Artificial Sequence: Synthetic oligonucleotide
uuuaacaaaagauuuguuuuuguag

SEQ ID NO: 1360 - RNA, 25 nt, Artificial Sequence
  Description of Artificial Sequence: Synthetic oligonucleotide
uuaacaaaagauuuguuuuuguaga

SEQ ID NO: 1361 - DNA, 25 bp, Artificial Sequence
  Description of Artificial Sequence: Synthetic oligonucleotide
  Description of Combined DNA/RNA Molecule: Synthetic oligonucleotide
caaaagauuuguuuuuguagagatt

SEQ ID NO: 1362 - DNA, 25 bp, Artificial Sequence
  Description of Artificial Sequence: Synthetic oligonucleotide
  Description of Combined DNA/RNA Molecule: Synthetic oligonucleotide
aaaagauuuguuuuuguagagautt

SEQ ID NO: 1363 - DNA, 25 bp, Artificial Sequence
  Description of Artificial Sequence: Synthetic oligonucleotide
  Description of Combined DNA/RNA Molecule: Synthetic oligonucleotide
aaagauuuguuuuuguagagauutt

SEQ ID NO: 1364 - RNA, 25 nt, Artificial Sequence
  Description of Artificial Sequence: Synthetic oligonucleotide
agauuuguuuuuguagagauuuuaa

SEQ ID NO: 1365 - RNA, 25 nt, Artificial Sequence
  Description of Artificial Sequence: Synthetic oligonucleotide
gauuuguuuuuguagagauuuuaaa

SEQ ID NO: 1366 - RNA, 25 nt, Artificial Sequence
  Description of Artificial Sequence: Synthetic oligonucleotide
auuuguuuuuguagagauuuuaaag

SEQ ID NO: 1367 - RNA, 25 nt, Artificial Sequence
  Description of Artificial Sequence: Synthetic oligonucleotide
uuuguuuuuguagagauuuuaaagg

SEQ ID NO: 1368 - RNA, 25 nt, Artificial Sequence
  Description of Artificial Sequence: Synthetic oligonucleotide
uuuguagagauuuuaaagggggaga

SEQ ID NO: 1369 - DNA, 25 bp, Artificial Sequence
  Description of Artificial Sequence: Synthetic oligonucleotide
  Description of Combined DNA/RNA Molecule: Synthetic oligonucleotide
gggggagaauucuagaaauaaaugt

SEQ ID NO: 1370 - DNA, 25 bp, Artificial Sequence
  Description of Artificial Sequence: Synthetic oligonucleotide
  Description of Combined DNA/RNA Molecule: Synthetic oligonucleotide
gggagaauucuagaaauaaauguta

SEQ ID NO: 1371 - RNA, 25 nt, Artificial Sequence
  Description of Artificial Sequence: Synthetic oligonucleotide
ggagaauucuagaaauaaauguuac

SEQ ID NO: 1372 - RNA, 25 nt, Artificial Sequence
  Description of Artificial Sequence: Synthetic oligonucleotide
gagaauucuagaaauaaauguuacc

SEQ ID NO: 1373 - DNA, 25 bp, Artificial Sequence
  Description of Artificial Sequence: Synthetic oligonucleotide
  Description of Combined DNA/RNA Molecule: Synthetic oligonucleotide
agaauucuagaaauaaauguuacct

SEQ ID NO: 1374 - DNA, 25 bp, Artificial Sequence
  Description of Artificial Sequence: Synthetic oligonucleotide
  Description of Artificial Sequence: Synthetic oligonucleotide
gaauucuagaaauaaauguuaccta

SEQ ID NO: 1375 - DNA, 25 bp, Artificial Sequence
  Description of Artificial Sequence: Synthetic oligonucleotide
  Description of Combined DNA/RNA Molecule: Synthetic oligonucleotide
cuagaaauaaauguuaccuaauuat

SEQ ID NO: 1376 - DNA, 25 bp, Artificial Sequence
  Description of Artificial Sequence: Synthetic oligonucleotide
  Description of Combined DNA/RNA Molecule: Synthetic oligonucleotide
uagaaauaaauguuaccuaauuatt

SEQ ID NO: 1377 - DNA, 25 bp, Artificial Sequence
  Description of Artificial Sequence: Synthetic oligonucleotide
  Description of Combined DNA/RNA Molecule: Synthetic oligonucleotide
agaaauaaauguuaccuaauuauta

SEQ ID NO: 1378 - RNA, 25 nt, Artificial Sequence
  Description of Artificial Sequence: Synthetic oligonucleotide
gaaauaaauguuaccuaauuauuac

SEQ ID NO: 1379 - RNA, 25 nt, Artificial Sequence
  Description of Artificial Sequence: Synthetic oligonucleotide
aaauaaauguuaccuaauuauuaca

SEQ ID NO: 1380 - RNA, 25 nt, Artificial Sequence
  Description of Artificial Sequence: Synthetic oligonucleotide
auaaauguuaccuaauuauuacagc

SEQ ID NO: 1381 - RNA, 25 nt, Artificial Sequence
  Description of Artificial Sequence: Synthetic oligonucleotide
cuaauuauuacagccuuaaagacaa

SEQ ID NO: 1382 - RNA, 25 nt, Artificial Sequence
  Description of Artificial Sequence: Synthetic oligonucleotide
uaauuauuacagccuuaaagacaaa

SEQ ID NO: 1383 - RNA, 25 nt, Artificial Sequence
  Description of Artificial Sequence: Synthetic oligonucleotide
uuaaagacaaaaauccuuguugaag

SEQ ID NO: 1384 - DNA, 25 bp, Artificial Sequence
  Description of Artificial Sequence: Synthetic oligonucleotide
  Description of Combined DNA/RNA Molecule: Synthetic oligonucleotide
aagacaaaaauccuuguugaagutt

SEQ ID NO: 1385 - RNA, 25 nt, Artificial Sequence
  Description of Artificial Sequence: Synthetic oligonucleotide
cuuguugaaguuuuuuuaaaaaaag

SEQ ID NO: 1386 - RNA, 25 nt, Artificial Sequence
  Description of Artificial Sequence: Synthetic oligonucleotide
uuguugaaguuuuuuuaaaaaaagc

SEQ ID NO: 1387 - DNA, 25 bp, Artificial Sequence
  Description of Artificial Sequence: Synthetic oligonucleotide
  Description of Combined DNA/RNA Molecule: Synthetic oligonucleotide
guugaaguuuuuuuaaaaaaagcta

SEQ ID NO: 1388 - RNA, 25 nt, Artificial Sequence
  Description of Artificial Sequence: Synthetic oligonucleotide
uugaaguuuuuuuaaaaaaagcuaa

SEQ ID NO: 1389 - DNA, 25 bp, Artificial Sequence
  Description of Artificial Sequence: Synthetic oligonucleotide
  Description of Combined DNA/RNA Molecule: Synthetic oligonucleotide
aguuuuuuuaaaaaaagcuaaauta

SEQ ID NO: 1390 - RNA, 25 nt, Artificial Sequence
  Description of Artificial Sequence: Synthetic oligonucleotide
guuuuuuuaaaaaaagcuaaauuac

SEQ ID NO: 1391 - RNA, 25 nt, Artificial Sequence
  Description of Artificial Sequence: Synthetic oligonucleotide
uuuuuuuaaaaaaagcuaaauuaca

SEQ ID NO: 1392 - DNA, 25 bp, Artificial Sequence
  Description of Artificial Sequence: Synthetic oligonucleotide
  Description of Combined DNA/RNA Molecule: Synthetic oligonucleotide
uuuuuuaaaaaaagcuaaauuacat

SEQ ID NO: 1393 - DNA, 25 bp, Artificial Sequence
  Description of Artificial Sequence: Synthetic oligonucleotide
  Description of Combined DNA/RNA Molecule: Synthetic oligonucleotide
uuuuuaaaaaaagcuaaauuacata

SEQ ID NO: 1394 - DNA, 25 bp, Artificial Sequence
  Description of Artificial Sequence: Synthetic oligonucleotide
  Description of Combined DNA/RNA Molecule: Synthetic oligonucleotide
uaaaaaaagcuaaauuacauagact

SEQ ID NO: 1395 - DNA, 25 bp, Artificial Sequence
  Description of Artificial Sequence: Synthetic oligonucleotide
  Description of Combined DNA/RNA Molecule: Synthetic oligonucleotide
aaaaaagcuaaauuacauagacuta

SEQ ID NO: 1396 - RNA, 25 nt, Artificial Sequence
  Description of Artificial Sequence: Synthetic oligonucleotide
uuaggcauuaacauguuuguggaag

SEQ ID NO: 1397 - RNA, 25 nt, Artificial Sequence
  Description of Artificial Sequence: Synthetic oligonucleotide
uaggcauuaacauguuuguggaaga

SEQ ID NO: 1398 - DNA, 25 bp, Artificial Sequence
  Description of Artificial Sequence: Synthetic oligonucleotide
  Description of Combined DNA/RNA Molecule: Synthetic oligonucleotide
cagacguauauuguaucauuugagt

SEQ ID NO: 1399 - DNA, 25 bp, Artificial Sequence
  Description of Artificial Sequence: Synthetic oligonucleotide
  Description of Combined DNA/RNA Molecule: Synthetic oligonucleotide
cguauauuguaucauuugagugaat

SEQ ID NO: 1400 - DNA, 25 bp, Artificial Sequence
  Description of Artificial Sequence: Synthetic oligonucleotide
  Description of Combined DNA/RNA Molecule: Synthetic oligonucleotide
uauauuguaucauuugagugaaugt

SEQ ID NO: 1401 - RNA, 25 nt, Artificial Sequence
  Description of Artificial Sequence: Synthetic oligonucleotide
auuguaucauuugagugaauguucc

SEQ ID NO: 1402 - RNA, 25 nt, Artificial Sequence
  Description of Artificial Sequence: Synthetic oligonucleotide
uuguaucauuugagugaauguuccc

SEQ ID NO: 1403 - RNA, 25 nt, Artificial Sequence
  Description of Artificial Sequence: Synthetic oligonucleotide
uguaucauuugagugaauguuccca

SEQ ID NO: 1404 - DNA, 25 bp, Artificial Sequence
  Description of Artificial Sequence: Synthetic oligonucleotide
  Description of Combined DNA/RNA Molecule: Synthetic oligonucleotide
aggaauuuagaaccuaacuuuuata

SEQ ID NO: 1405 - RNA, 25 nt, Artificial Sequence
  Description of Artificial Sequence: Synthetic oligonucleotide
ggaauuuagaaccuaacuuuuauag

SEQ ID NO: 1406 - DNA, 25 bp, Artificial Sequence
  Description of Artificial Sequence: Synthetic oligonucleotide
  Description of Combined DNA/RNA Molecule: Synthetic oligonucleotide
uuuagaaccuaacuuuuauagguta

SEQ ID NO: 1407 - DNA, 25 bp, Artificial Sequence
  Description of Artificial Sequence: Synthetic oligonucleotide
  Description of Combined DNA/RNA Molecule: Synthetic oligonucleotide
uuagaaccuaacuuuuauagguuat

SEQ ID NO: 1408 - DNA, 25 bp, Artificial Sequence
  Description of Artificial Sequence: Synthetic oligonucleotide
  Description of Combined DNA/RNA Molecule: Synthetic oligonucleotide
uagaaccuaacuuuuauagguuatc

SEQ ID NO: 1409 - RNA, 25 nt, Artificial Sequence
  Description of Artificial Sequence: Synthetic oligonucleotide
agaaccuaacuuuuauagguuauca

SEQ ID NO: 1410 - RNA, 25 nt, Artificial Sequence
  Description of Artificial Sequence: Synthetic oligonucleotide
uuauagguuaucaaaacuguuguca

SEQ ID NO: 1411 - RNA, 25 nt, Artificial Sequence
  Description of Artificial Sequence: Synthetic oligonucleotide
auagguuaucaaaacuguugucacc

SEQ ID NO: 1412 - RNA, 25 nt, Artificial Sequence
  Description of Artificial Sequence: Synthetic oligonucleotide
uuuuguccuaauauauacauagaaa

SEQ ID NO: 1413 - RNA, 25 nt, Artificial Sequence
  Description of Artificial Sequence: Synthetic oligonucleotide
uuuguccuaauauauacauagaaac

SEQ ID NO: 1414 - DNA, 25 bp, Artificial Sequence
  Description of Artificial Sequence: Synthetic oligonucleotide
  Description of Combined DNA/RNA Molecule: Synthetic oligonucleotide
uuguccuaauauauacauagaaact

SEQ ID NO: 1415 - RNA, 25 nt, Artificial Sequence
  Description of Artificial Sequence: Synthetic oligonucleotide
uaauauauacauagaaacuuugugg

SEQ ID NO: 1416 - DNA, 25 bp, Artificial Sequence
  Description of Artificial Sequence: Synthetic oligonucleotide
  Description of Combined DNA/RNA Molecule: Synthetic oligonucleotide
uauacauagaaacuuuguggggcat

SEQ ID NO: 1417 - DNA, 25 bp, Artificial Sequence
  Description of Artificial Sequence: Synthetic oligonucleotide
  Description of Combined DNA/RNA Molecule: Synthetic oligonucleotide
caaguucaucucauuuguauuccat

SEQ ID NO: 1418 - DNA, 25 bp, Artificial Sequence
  Description of Artificial Sequence: Synthetic oligonucleotide
  Description of Combined DNA/RNA Molecule: Synthetic oligonucleotide
cauuuguauuccauugauuuuuutt

SEQ ID NO: 1419 - DNA, 25 bp, Artificial Sequence
  Description of Artificial Sequence: Synthetic oligonucleotide
  Description of Combined DNA/RNA Molecule: Synthetic oligonucleotide
auuuguauuccauugauuuuuuutt

SEQ ID NO: 1420 - DNA, 25 bp, Artificial Sequence
  Description of Artificial Sequence: Synthetic oligonucleotide
  Description of Combined DNA/RNA Molecule: Synthetic oligonucleotide
uuuguauuccauugauuuuuuuutt

SEQ ID NO: 1421 - DNA, 25 bp, Artificial Sequence
  Description of Artificial Sequence: Synthetic oligonucleotide
  Description of Combined DNA/RNA Molecule: Synthetic oligonucleotide
uuguauuccauugauuuuuuuuutc

SEQ ID NO: 1422 - DNA, 25 bp, Artificial Sequence
  Description of Artificial Sequence: Synthetic oligonucleotide
  Description of Combined DNA/RNA Molecule: Synthetic oligonucleotide
uguauuccauugauuuuuuuuuuct

SEQ ID NO: 1423 - DNA, 25 bp, Artificial Sequence
  Description of Artificial Sequence: Synthetic oligonucleotide
  Description of Combined DNA/RNA Molecule: Synthetic oligonucleotide
guauuccauugauuuuuuuuuuctt

SEQ ID NO: 1424 - DNA, 25 bp, Artificial Sequence
  Description of Artificial Sequence: Synthetic oligonucleotide
  Description of Combined DNA/RNA Molecule: Synthetic oligonucleotide
uauuccauugauuuuuuuuuucutc

SEQ ID NO: 1425 - DNA, 25 bp, Artificial Sequence
  Description of Artificial Sequence: Synthetic oligonucleotide
  Description of Combined DNA/RNA Molecule: Synthetic oligonucleotide
uugauuuuuuuuuucuucuaaacat

SEQ ID NO: 1426 - DNA, 25 bp, Artificial Sequence
  Description of Artificial Sequence: Synthetic oligonucleotide
  Description of Combined DNA/RNA Molecule: Synthetic oligonucleotide
ugauuuuuuuuuucuucuaaacatt

SEQ ID NO: 1427 - DNA, 25 bp, Artificial Sequence
  Description of Artificial Sequence: Synthetic oligonucleotide
  Description of Combined DNA/RNA Molecule: Synthetic oligonucleotide
uuuuuuuuucuucuaaacauuuutt

SEQ ID NO: 1428 - DNA, 25 bp, Artificial Sequence
  Description of Artificial Sequence: Synthetic oligonucleotide
  Description of Combined DNA/RNA Molecule: Synthetic oligonucleotide
uuuuuuuucuucuaaacauuuuutc

SEQ ID NO: 1429 - DNA, 25 bp, Artificial Sequence
  Description of Artificial Sequence: Synthetic oligonucleotide
  Description of Combined DNA/RNA Molecule: Synthetic oligonucleotide
uuuuuuucuucuaaacauuuuuuct

SEQ ID NO: 1430 - DNA, 25 bp, Artificial Sequence
  Description of Artificial Sequence: Synthetic oligonucleotide
  Description of Combined DNA/RNA Molecule: Synthetic oligonucleotide
uuuuuucuucuaaacauuuuuuctt

SEQ ID NO: 1431 - DNA, 25 bp, Artificial Sequence
  Description of Artificial Sequence: Synthetic oligonucleotide
  Description of Combined DNA/RNA Molecule: Synthetic oligonucleotide
uuuuucuucuaaacauuuuuucutc

SEQ ID NO: 1432 - RNA, 25 nt, Artificial Sequence
  Description of Artificial Sequence: Synthetic oligonucleotide
cauuuuuucuucaaacaguauauaa

SEQ ID NO: 1433 - RNA, 25 nt, Artificial Sequence
  Description of Artificial Sequence: Synthetic oligonucleotide
auuuuuucuucaaacaguauauaac

SEQ ID NO: 1434 - DNA, 25 bp, Artificial Sequence
  Description of Artificial Sequence: Synthetic oligonucleotide
  Description of Combined DNA/RNA Molecule: Synthetic oligonucleotide
uuuuuucuucaaacaguauauaact

SEQ ID NO: 1435 - DNA, 25 bp, Artificial Sequence
  Description of Artificial Sequence: Synthetic oligonucleotide
  Description of Combined DNA/RNA Molecule: Synthetic oligonucleotide
uuuuucuucaaacaguauauaactt

SEQ ID NO: 1436 - DNA, 25 bp, Artificial Sequence
  Description of Artificial Sequence: Synthetic oligonucleotide
  Description of Combined DNA/RNA Molecule: Synthetic oligonucleotide
uuuucuucaaacaguauauaacutt

SEQ ID NO: 1437 - RNA, 25 nt, Artificial Sequence
  Description of Artificial Sequence: Synthetic oligonucleotide
caaacaguauauaacuuuuuuuagg

SEQ ID NO: 1438 - DNA, 25 bp, Artificial Sequence
  Description of Artificial Sequence: Synthetic oligonucleotide
  Description of Combined DNA/RNA Molecule: Synthetic oligonucleotide
aguauauaacuuuuuuuaggggatt

SEQ ID NO: 1439 - DNA, 25 bp, Artificial Sequence
  Description of Artificial Sequence: Synthetic oligonucleotide
  Description of Combined DNA/RNA Molecule: Synthetic oligonucleotide
guauauaacuuuuuuuaggggautt

SEQ ID NO: 1440 - DNA, 25 bp, Artificial Sequence
  Description of Artificial Sequence: Synthetic oligonucleotide
  Description of Combined DNA/RNA Molecule: Synthetic oligonucleotide
uauauaacuuuuuuuaggggauutt

SEQ ID NO: 1441 - DNA, 25 bp, Artificial Sequence
  Description of Artificial Sequence: Synthetic oligonucleotide
  Description of Combined DNA/RNA Molecule: Synthetic oligonucleotide
auauaacuuuuuuuaggggauuutt

SEQ ID NO: 1442 - RNA, 25 nt, Artificial Sequence
  Description of Artificial Sequence: Synthetic oligonucleotide
cuuuuuuuaggggauuuuuuuuuag

SEQ ID NO: 1443 - RNA, 25 nt, Artificial Sequence
  Description of Artificial Sequence: Synthetic oligonucleotide
uuuuuuuaggggauuuuuuuuuaga

SEQ ID NO: 1444 - DNA, 25 bp, Artificial Sequence
  Description of Artificial Sequence: Synthetic oligonucleotide
  Description of Combined DNA/RNA Molecule: Synthetic oligonucleotide
gauuuuuuuuuagacagcaaaaact

SEQ ID NO: 1445 - DNA, 25 bp, Artificial Sequence
  Description of Artificial Sequence: Synthetic oligonucleotide
  Description of Combined DNA/RNA Molecule: Synthetic oligonucleotide
auuuuuuuuuagacagcaaaaacta

SEQ ID NO: 1446 - DNA, 25 bp, Artificial Sequence
  Description of Artificial Sequence: Synthetic oligonucleotide
  Description of Combined DNA/RNA Molecule: Synthetic oligonucleotide
uuuuuuuuuagacagcaaaaacuat

SEQ ID NO: 1447 - RNA, 25 nt, Artificial Sequence
  Description of Artificial Sequence: Synthetic oligonucleotide
aagauuuccauuugucaaaaaguaa

SEQ ID NO: 1448 - DNA, 25 bp, Artificial Sequence
  Description of Artificial Sequence: Synthetic oligonucleotide
  Description of Combined DNA/RNA Molecule: Synthetic oligonucleotide
agauuuccauuugucaaaaaguaat

SEQ ID NO: 1449 - DNA, 25 bp, Artificial Sequence
  Description of Artificial Sequence: Synthetic oligonucleotide
  Description of Combined DNA/RNA Molecule: Synthetic oligonucleotide
gauuuccauuugucaaaaaguaatg

SEQ ID NO: 1450 - RNA, 25 nt, Artificial Sequence
  Description of Artificial Sequence: Synthetic oligonucleotide
auuuccauuugucaaaaaguaauga

SEQ ID NO: 1451 - DNA, 25 bp, Artificial Sequence
  Description of Artificial Sequence: Synthetic oligonucleotide
  Description of Combined DNA/RNA Molecule: Synthetic oligonucleotide
cauuugucaaaaaguaaugauuuct

SEQ ID NO: 1452 - DNA, 25 bp, Artificial Sequence
  Description of Artificial Sequence: Synthetic oligonucleotide
  Description of Combined DNA/RNA Molecule: Synthetic oligonucleotide
auuugucaaaaaguaaugauuuctt

SEQ ID NO: 1453 - DNA, 25 bp, Artificial Sequence
  Description of Artificial Sequence: Synthetic oligonucleotide
  Description of Combined DNA/RNA Molecule: Synthetic oligonucleotide
uuugucaaaaaguaaugauuucutg

SEQ ID NO: 1454 - DNA, 25 bp, Artificial Sequence
  Description of Artificial Sequence: Synthetic oligonucleotide
  Description of Combined DNA/RNA Molecule: Synthetic oligonucleotide
caaaaaguaaugauuucuugauaat

SEQ ID NO: 1455 - DNA, 25 bp, Artificial Sequence
  Description of Artificial Sequence: Synthetic oligonucleotide
  Description of Combined DNA/RNA Molecule: Synthetic oligonucleotide
aaaaaguaaugauuucuugauaatt

SEQ ID NO: 1456 - DNA, 25 bp, Artificial Sequence
  Description of Artificial Sequence: Synthetic oligonucleotide
  Description of Combined DNA/RNA Molecule: Synthetic oligonucleotide
aaaaguaaugauuucuugauaautg

SEQ ID NO: 1457 - DNA, 25 bp, Artificial Sequence
  Description of Artificial Sequence: Synthetic oligonucleotide
  Description of Combined DNA/RNA Molecule: Synthetic oligonucleotide
aaaguaaugauuucuugauaauugt

SEQ ID NO: 1458 - DNA, 25 bp, Artificial Sequence
  Description of Artificial Sequence: Synthetic oligonucleotide
  Description of Combined DNA/RNA Molecule: Synthetic oligonucleotide
aguaaugauuucuugauaauugugt

SEQ ID NO: 1459 - RNA, 25 nt, Artificial Sequence
  Description of Artificial Sequence: Synthetic oligonucleotide
uaaugauuucuugauaauuguguag

SEQ ID NO: 1460 - DNA, 25 bp, Artificial Sequence
  Description of Artificial Sequence: Synthetic oligonucleotide
  Description of Combined DNA/RNA Molecule: Synthetic oligonucleotide
aaugauuucuugauaauuguguagt

SEQ ID NO: 1461 - RNA, 25 nt, Artificial Sequence
  Description of Artificial Sequence: Synthetic oligonucleotide
ugauuucuugauaauuguguaguaa

SEQ ID NO: 1462 - DNA, 25 bp, Artificial Sequence
  Description of Artificial Sequence: Synthetic oligonucleotide
  Description of Combined DNA/RNA Molecule: Synthetic oligonucleotide
gauuucuugauaauuguguaguaat

SEQ ID NO: 1463 - DNA, 25 bp, Artificial Sequence
  Description of Artificial Sequence: Synthetic oligonucleotide
  Description of Combined DNA/RNA Molecule: Synthetic oligonucleotide
cuugauaauuguguaguaauguutt

SEQ ID NO: 1464 - DNA, 25 bp, Artificial Sequence
  Description of Artificial Sequence: Synthetic oligonucleotide
  Description of Combined DNA/RNA Molecule: Synthetic oligonucleotide
uugauaauuguguaguaauguuutt

SEQ ID NO: 1465 - DNA, 25 bp, Artificial Sequence
  Description of Artificial Sequence: Synthetic oligonucleotide
  Description of Combined DNA/RNA Molecule: Synthetic oligonucleotide
ugauaauuguguaguaauguuuutt

SEQ ID NO: 1466 - RNA, 25 nt, Artificial Sequence
  Description of Artificial Sequence: Synthetic oligonucleotide
auaauuguguaguaauguuuuuuag

SEQ ID NO: 1467 - RNA, 25 nt, Artificial Sequence
  Description of Artificial Sequence: Synthetic oligonucleotide
auuguguaguaauguuuuuuagaac

SEQ ID NO: 1468 - RNA, 25 nt, Artificial Sequence
  Description of Artificial Sequence: Synthetic oligonucleotide
uguguaguaauguuuuuuagaaccc

SEQ ID NO: 1469 - RNA, 25 nt, Artificial Sequence
  Description of Artificial Sequence: Synthetic oligonucleotide
guguaguaauguuuuuuagaaccca

SEQ ID NO: 1470 - RNA, 25 nt, Artificial Sequence
  Description of Artificial Sequence: Synthetic oligonucleotide
uuaaagcugaauuuauauuuaguaa

SEQ ID NO: 1471 - DNA, 25 bp, Artificial Sequence
  Description of Artificial Sequence: Synthetic oligonucleotide
  Description of Combined DNA/RNA Molecule: Synthetic oligonucleotide
aaagcugaauuuauauuuaguaact

SEQ ID NO: 1472 - DNA, 25 bp, Artificial Sequence
  Description of Artificial Sequence: Synthetic oligonucleotide
  Description of Combined DNA/RNA Molecule: Synthetic oligonucleotide
uuuauauuuaguaacuucuguguta

SEQ ID NO: 1473 - RNA, 25 nt, Artificial Sequence
  Description of Artificial Sequence: Synthetic oligonucleotide
uuauauuuaguaacuucuguguuaa

SEQ ID NO: 1474 - DNA, 25 bp, Artificial Sequence
  Description of Artificial Sequence: Synthetic oligonucleotide
  Description of Combined DNA/RNA Molecule: Synthetic oligonucleotide
uauauuuaguaacuucuguguuaat

SEQ ID NO: 1475 - RNA, 25 nt, Artificial Sequence
  Description of Artificial Sequence: Synthetic oligonucleotide
uuaguaacuucuguguuaauacugg

SEQ ID NO: 1476 - DNA, 25 bp, Artificial Sequence
  Description of Artificial Sequence: Synthetic oligonucleotide
  Description of Combined DNA/RNA Molecule: Synthetic oligonucleotide
ugaauagcugucauaaaaugaaact

SEQ ID NO: 1477 - DNA, 25 bp, Artificial Sequence
  Description of Artificial Sequence: Synthetic oligonucleotide
  Description of Combined DNA/RNA Molecule: Synthetic oligonucleotide
gaauagcugucauaaaaugaaactt

SEQ ID NO: 1478 - RNA, 25 nt, Artificial Sequence
  Description of Artificial Sequence: Synthetic oligonucleotide
aaaugaaacuuucuuucuaaagaaa

SEQ ID NO: 1479 - RNA, 25 nt, Artificial Sequence
  Description of Artificial Sequence: Synthetic oligonucleotide
aaugaaacuuucuuucuaaagaaag

SEQ ID NO: 1480 - RNA, 25 nt, Artificial Sequence
  Description of Artificial Sequence: Synthetic oligonucleotide
augaaacuuucuuucuaaagaaaga

SEQ ID NO: 1481 - DNA, 25 bp, Artificial Sequence
  Description of Artificial Sequence: Synthetic oligonucleotide
  Description of Combined DNA/RNA Molecule: Synthetic oligonucleotide
gaaacuuucuuucuaaagaaagata

SEQ ID NO: 1482 - RNA, 25 nt, Artificial Sequence
  Description of Artificial Sequence: Synthetic oligonucleotide
cuuucuuucuaaagaaagauacuca

SEQ ID NO: 1483 - DNA, 25 bp, Artificial Sequence
  Description of Artificial Sequence: Synthetic oligonucleotide
  Description of Combined DNA/RNA Molecule: Synthetic oligonucleotide
caugaguucuugaagaauagucata

SEQ ID NO: 1484 - DNA, 25 bp, Artificial Sequence
  Description of Artificial Sequence: Synthetic oligonucleotide
  Description of Combined DNA/RNA Molecule: Synthetic oligonucleotide
uugaagaauagucauaacuagauta

SEQ ID NO: 1485 - RNA, 25 nt, Artificial Sequence
  Description of Artificial Sequence: Synthetic oligonucleotide
ugaagaauagucauaacuagauuaa

SEQ ID NO: 1486 - RNA, 25 nt, Artificial Sequence
  Description of Artificial Sequence: Synthetic oligonucleotide
gaagaauagucauaacuagauuaag

SEQ ID NO: 1487 - DNA, 25 bp, Artificial Sequence
  Description of Artificial Sequence: Synthetic oligonucleotide
  Description of Combined DNA/RNA Molecule: Synthetic oligonucleotide
gaauagucauaacuagauuaagatc

SEQ ID NO: 1488 - DNA, 25 bp, Artificial Sequence
  Description of Artificial Sequence: Synthetic oligonucleotide
  Description of Combined DNA/RNA Molecule: Synthetic oligonucleotide
aauagucauaacuagauuaagauct

SEQ ID NO: 1489 - DNA, 25 bp, Artificial Sequence
  Description of Artificial Sequence: Synthetic oligonucleotide
  Description of Combined DNA/RNA Molecule: Synthetic oligonucleotide
auagucauaacuagauuaagauctg

SEQ ID NO: 1490 - DNA, 25 bp, Artificial Sequence
  Description of Artificial Sequence: Synthetic oligonucleotide
  Description of Combined DNA/RNA Molecule: Synthetic oligonucleotide
uagucauaacuagauuaagaucugt

SEQ ID NO: 1491 - DNA, 25 bp, Artificial Sequence
  Description of Artificial Sequence: Synthetic oligonucleotide
  Description of Combined DNA/RNA Molecule: Synthetic oligonucleotide
cauaacuagauuaagaucugugutt

SEQ ID NO: 1492 - DNA, 25 bp, Artificial Sequence
  Description of Artificial Sequence: Synthetic oligonucleotide
  Description of Combined DNA/RNA Molecule: Synthetic oligonucleotide
uagauuaagaucuguguuuuagutt

SEQ ID NO: 1493 - RNA, 25 nt, Artificial Sequence
  Description of Artificial Sequence: Synthetic oligonucleotide
gauuaagaucuguguuuuaguuuaa

SEQ ID NO: 1494 - DNA, 25 bp, Artificial Sequence
  Description of Artificial Sequence: Synthetic oligonucleotide
  Description of Combined DNA/RNA Molecule: Synthetic oligonucleotide
auuaagaucuguguuuuaguuuaat

SEQ ID NO: 1495 - RNA, 25 nt, Artificial Sequence
  Description of Artificial Sequence: Synthetic oligonucleotide
uaagaucuguguuuuaguuuaauag

SEQ ID NO: 1496 - RNA, 25 nt, Artificial Sequence
  Description of Artificial Sequence: Synthetic oligonucleotide
uguguuuuaguuuaauaguuugaag

SEQ ID NO: 1497 - DNA, 25 bp, Artificial Sequence
  Description of Artificial Sequence: Synthetic oligonucleotide
  Description of Combined DNA/RNA Molecule: Synthetic oligonucleotide
guguuuuaguuuaauaguuugaagt

SEQ ID NO: 1498 - RNA, 25 nt, Artificial Sequence
  Description of Artificial Sequence: Synthetic oligonucleotide
guuuuaguuuaauaguuugaagugc

SEQ ID NO: 1499 - DNA, 25 bp, Artificial Sequence
  Description of Artificial Sequence: Synthetic oligonucleotide
  Description of Combined DNA/RNA Molecule: Synthetic oligonucleotide
uuuaguuuaauaguuugaagugcct

SEQ ID NO: 1500 - DNA, 25 bp, Artificial Sequence
  Description of Artificial Sequence: Synthetic oligonucleotide
  Description of Combined DNA/RNA Molecule: Synthetic oligonucleotide
uuaguuuaauaguuugaagugcctg

SEQ ID NO: 1501 - RNA, 25 nt, Artificial Sequence
  Description of Artificial Sequence: Synthetic oligonucleotide
uugggauaaugauagguaauuuaga

SEQ ID NO: 1502 - DNA, 25 bp, Artificial Sequence
  Description of Artificial Sequence: Synthetic oligonucleotide
  Description of Combined DNA/RNA Molecule: Synthetic oligonucleotide
gggauaaugauagguaauuuagatg

SEQ ID NO: 1503 - DNA, 25 bp, Artificial Sequence
  Description of Artificial Sequence: Synthetic oligonucleotide
  Description of Combined DNA/RNA Molecule: Synthetic oligonucleotide
auaaugauagguaauuuagaugaat

SEQ ID NO: 1504 - DNA, 25 bp, Artificial Sequence
  Description of Artificial Sequence: Synthetic oligonucleotide
  Description of Combined DNA/RNA Molecule: Synthetic oligonucleotide
uaaugauagguaauuuagaugaatt

SEQ ID NO: 1505 - RNA, 25 nt, Artificial Sequence
  Description of Artificial Sequence: Synthetic oligonucleotide
ugauagguaauuuagaugaauuuag

SEQ ID NO: 1506 - RNA, 25 nt, Artificial Sequence
  Description of Artificial Sequence: Synthetic oligonucleotide
gauagguaauuuagaugaauuuagg

SEQ ID NO: 1507 - RNA, 25 nt, Artificial Sequence
  Description of Artificial Sequence: Synthetic oligonucleotide
guaauuuagaugaauuuaggggaaa

SEQ ID NO: 1508 - RNA, 25 nt, Artificial Sequence
  Description of Artificial Sequence: Synthetic oligonucleotide
aauuuagaugaauuuaggggaaaaa

SEQ ID NO: 1509 - DNA, 25 bp, Artificial Sequence
  Description of Artificial Sequence: Synthetic oligonucleotide
  Description of Combined DNA/RNA Molecule: Synthetic oligonucleotide
augaauuuaggggaaaaaaaaguta

SEQ ID NO: 1510 - DNA, 25 bp, Artificial Sequence
  Description of Artificial Sequence: Synthetic oligonucleotide
  Description of Combined DNA/RNA Molecule: Synthetic oligonucleotide
ugaauuuaggggaaaaaaaaguuat

SEQ ID NO: 1511 - DNA, 25 bp, Artificial Sequence
  Description of Artificial Sequence: Synthetic oligonucleotide
  Description of Combined DNA/RNA Molecule: Synthetic oligonucleotide
gaaaaaaaaguuaucugcagauatg

SEQ ID NO: 1512 - DNA, 25 bp, Artificial Sequence
  Description of Artificial Sequence: Synthetic oligonucleotide
  Description of Combined DNA/RNA Molecule: Synthetic oligonucleotide
aaaaaaaaguuaucugcagauaugt

SEQ ID NO: 1513 - RNA, 25 nt, Artificial Sequence
  Description of Artificial Sequence: Synthetic oligonucleotide
aaaguuaucugcagauauguugagg

SEQ ID NO: 1514 - DNA, 25 bp, Artificial Sequence
  Description of Artificial Sequence: Synthetic oligonucleotide
  Description of Combined DNA/RNA Molecule: Synthetic oligonucleotide
cuuguguuuucauguugaaaauact

SEQ ID NO: 1515 - DNA, 25 bp, Artificial Sequence
  Description of Artificial Sequence: Synthetic oligonucleotide
  Description of Combined DNA/RNA Molecule: Synthetic oligonucleotide
uuguguuuucauguugaaaauactt

SEQ ID NO: 1516 - DNA, 25 bp, Artificial Sequence
  Description of Artificial Sequence: Synthetic oligonucleotide
  Description of Combined DNA/RNA Molecule: Synthetic oligonucleotide
uguguuuucauguugaaaauacutt

SEQ ID NO: 1517 - DNA, 25 bp, Artificial Sequence
  Description of Artificial Sequence: Synthetic oligonucleotide
  Description of Combined DNA/RNA Molecule: Synthetic oligonucleotide
uguugaaaauacuuuugcauuuutc

SEQ ID NO: 1518 - RNA, 25 nt, Artificial Sequence
  Description of Artificial Sequence: Synthetic oligonucleotide
guugaaaauacuuuugcauuuuucc

SEQ ID NO: 1519 - DNA, 25 bp, Artificial Sequence
  Description of Artificial Sequence: Synthetic oligonucleotide
  Description of Combined DNA/RNA Molecule: Synthetic oligonucleotide
uugaaaauacuuuugcauuuuucct

SEQ ID NO: 1520 - DNA, 25 bp, Artificial Sequence
  Description of Artificial Sequence: Synthetic oligonucleotide
  Description of Combined DNA/RNA Molecule: Synthetic oligonucleotide
ugaaaauacuuuugcauuuuucctt

SEQ ID NO: 1521 - RNA, 25 nt, Artificial Sequence
  Description of Artificial Sequence: Synthetic oligonucleotide
uuugcauuuuuccuuugagugccaa

SEQ ID NO: 1522 - DNA, 25 bp, Artificial Sequence
  Description of Artificial Sequence: Synthetic oligonucleotide
  Description of Combined DNA/RNA Molecule: Synthetic oligonucleotide
agugccaauuucuuacuaguacuat

SEQ ID NO: 1523 - DNA, 25 bp, Artificial Sequence
  Description of Artificial Sequence: Synthetic oligonucleotide
  Description of Combined DNA/RNA Molecule: Synthetic oligonucleotide
caauuucuuacuaguacuauuuctt

SEQ ID NO: 1524 - DNA, 25 bp, Artificial Sequence
  Description of Artificial Sequence: Synthetic oligonucleotide
  Description of Combined DNA/RNA Molecule: Synthetic oligonucleotide
aauuucuuacuaguacuauuucuta

SEQ ID NO: 1525 - DNA, 25 bp, Artificial Sequence
  Description of Artificial Sequence: Synthetic oligonucleotide
  Description of Combined DNA/RNA Molecule: Synthetic oligonucleotide
cuaguacuauuucuuaauguaacat

SEQ ID NO: 1526 - DNA, 25 bp, Artificial Sequence
  Description of Artificial Sequence: Synthetic oligonucleotide
  Description of Combined DNA/RNA Molecule: Synthetic oligonucleotide
uaguacuauuucuuaauguaacatg

SEQ ID NO: 1527 - RNA, 25 nt, Artificial Sequence
  Description of Artificial Sequence: Synthetic oligonucleotide
cuauuucuuaauguaacauguuuac

SEQ ID NO: 1528 - RNA, 25 nt, Artificial Sequence
  Description of Artificial Sequence: Synthetic oligonucleotide
uauuucuuaauguaacauguuuacc

SEQ ID NO: 1529 - DNA, 25 bp, Artificial Sequence
  Description of Artificial Sequence: Synthetic oligonucleotide
  Description of Combined DNA/RNA Molecule: Synthetic oligonucleotide
auuucuuaauguaacauguuuacct

SEQ ID NO: 1530 - DNA, 25 bp, Artificial Sequence
  Description of Artificial Sequence: Synthetic oligonucleotide
  Description of Combined DNA/RNA Molecule: Synthetic oligonucleotide
aauguaacauguuuaccuggaaugt

SEQ ID NO: 1531 - DNA, 25 bp, Artificial Sequence
  Description of Artificial Sequence: Synthetic oligonucleotide
  Description of Combined DNA/RNA Molecule: Synthetic oligonucleotide
uggaauguauuuuaacuauuuuugt

SEQ ID NO: 1532 - DNA, 25 bp, Artificial Sequence
  Description of Artificial Sequence: Synthetic oligonucleotide
  Description of Combined DNA/RNA Molecule: Synthetic oligonucleotide
gaauguauuuuaacuauuuuuguat

SEQ ID NO: 1533 - DNA, 25 bp, Artificial Sequence
  Description of Artificial Sequence: Synthetic oligonucleotide
  Description of Combined DNA/RNA Molecule: Synthetic oligonucleotide
aauguauuuuaacuauuuuuguata

SEQ ID NO: 1534 - RNA, 25 nt, Artificial Sequence
  Description of Artificial Sequence: Synthetic oligonucleotide
auguauuuuaacuauuuuuguauag

SEQ ID NO: 1535 - DNA, 25 bp, Artificial Sequence
  Description of Artificial Sequence: Synthetic oligonucleotide
  Description of Combined DNA/RNA Molecule: Synthetic oligonucleotide
uguauuuuaacuauuuuuguauagt

SEQ ID NO: 1536 - DNA, 25 bp, Artificial Sequence
  Description of Artificial Sequence: Synthetic oligonucleotide
  Description of Combined DNA/RNA Molecule: Synthetic oligonucleotide
uauuuuaacuauuuuuguauagugt

SEQ ID NO: 1537 - RNA, 25 nt, Artificial Sequence
  Description of Artificial Sequence: Synthetic oligonucleotide
uuuuaacuauuuuuguauaguguaa

SEQ ID NO: 1538 - RNA, 25 nt, Artificial Sequence
  Description of Artificial Sequence: Synthetic oligonucleotide
uuuaacuauuuuuguauaguguaaa

SEQ ID NO: 1539 - RNA, 25 nt, Artificial Sequence
  Description of Artificial Sequence: Synthetic oligonucleotide
uuaacuauuuuuguauaguguaaac

SEQ ID NO: 1540 - RNA, 25 nt, Artificial Sequence
  Description of Artificial Sequence: Synthetic oligonucleotide
uuuuuguauaguguaaacugaaaca

SEQ ID NO: 1541 - DNA, 25 bp, Artificial Sequence
  Description of Artificial Sequence: Synthetic oligonucleotide
  Description of Combined DNA/RNA Molecule: Synthetic oligonucleotide
uuuuguauaguguaaacugaaacat

SEQ ID NO: 1542 - DNA, 25 bp, Artificial Sequence
  Description of Artificial Sequence: Synthetic oligonucleotide
  Description of Combined DNA/RNA Molecule: Synthetic oligonucleotide
uuuguauaguguaaacugaaacatg

SEQ ID NO: 1543 - DNA, 25 bp, Artificial Sequence
  Description of Artificial Sequence: Synthetic oligonucleotide
  Description of Combined DNA/RNA Molecule: Synthetic oligonucleotide
cugaaacaugcacauuuuguacatt

SEQ ID NO: 1544 - DNA, 25 bp, Artificial Sequence
  Description of Artificial Sequence: Synthetic oligonucleotide
  Description of Combined DNA/RNA Molecule: Synthetic oligonucleotide
caugcacauuuuguacauugugctt

SEQ ID NO: 1545 - RNA, 25 nt, Artificial Sequence
  Description of Artificial Sequence: Synthetic oligonucleotide
caguuguuuuccaucauuugguugc

SEQ ID NO: 1546 - RNA, 25 nt, Artificial Sequence
  Description of Artificial Sequence: Synthetic oligonucleotide
guuguuuuccaucauuugguugcgc

SEQ ID NO: 1547 - DNA, 25 bp, Artificial Sequence
  Description of Artificial Sequence: Synthetic oligonucleotide
  Description of Combined DNA/RNA Molecule: Synthetic oligonucleotide
guuggucauaucaaacauuaaaaat

SEQ ID NO: 1548 - DNA, 25 bp, Artificial Sequence
  Description of Artificial Sequence: Synthetic oligonucleotide
  Description of Combined DNA/RNA Molecule: Synthetic oligonucleotide
uuggucauaucaaacauuaaaaatg

SEQ ID NO: 1549 - RNA, 25 nt, Artificial Sequence
  Description of Artificial Sequence: Synthetic oligonucleotide
uggucauaucaaacauuaaaaauga

SEQ ID NO: 1550 - RNA, 25 nt, Artificial Sequence
  Description of Artificial Sequence: Synthetic oligonucleotide
cauaucaaacauuaaaaaugaccac

SEQ ID NO: 1551 - DNA, 25 bp, Artificial Sequence
  Description of Artificial Sequence: Synthetic oligonucleotide
  Description of Combined DNA/RNA Molecule: Synthetic oligonucleotide
aaugaccacucuuuuaauugaaatt

SEQ ID NO: 1552 - DNA, 25 bp, Artificial Sequence
  Description of Artificial Sequence: Synthetic oligonucleotide
  Description of Combined DNA/RNA Molecule: Synthetic oligonucleotide
augaccacucuuuuaauugaaauta

SEQ ID NO: 1553 - RNA, 25 nt, Artificial Sequence
  Description of Artificial Sequence: Synthetic oligonucleotide
cuuuuaauugaaauuaacuuuuaaa

SEQ ID NO: 1554 - DNA, 25 bp, Artificial Sequence
  Description of Artificial Sequence: Synthetic oligonucleotide
  Description of Combined DNA/RNA Molecule: Synthetic oligonucleotide
uuuuaauugaaauuaacuuuuaaat

SEQ ID NO: 1555 - DNA, 25 bp, Artificial Sequence
  Description of Artificial Sequence: Synthetic oligonucleotide
  Description of Combined DNA/RNA Molecule: Synthetic oligonucleotide
uuaauugaaauuaacuuuuaaaugt

SEQ ID NO: 1556 - DNA, 25 bp, Artificial Sequence
  Description of Artificial Sequence: Synthetic oligonucleotide
  Description of Combined DNA/RNA Molecule: Synthetic oligonucleotide
aauugaaauuaacuuuuaaaugutt

SEQ ID NO: 1557 - DNA, 25 bp, Artificial Sequence
  Description of Artificial Sequence: Synthetic oligonucleotide
  Description of Combined DNA/RNA Molecule: Synthetic oligonucleotide
auugaaauuaacuuuuaaauguuta

SEQ ID NO: 1558 - DNA, 25 bp, Artificial Sequence
  Description of Artificial Sequence: Synthetic oligonucleotide
  Description of Combined DNA/RNA Molecule: Synthetic oligonucleotide
uugaaauuaacuuuuaaauguuuat

SEQ ID NO: 1559 - DNA, 25 bp, Artificial Sequence
  Description of Artificial Sequence: Synthetic oligonucleotide
  Description of Combined DNA/RNA Molecule: Synthetic oligonucleotide
ugaaauuaacuuuuaaauguuuata

SEQ ID NO: 1560 - RNA, 25 nt, Artificial Sequence
  Description of Artificial Sequence: Synthetic oligonucleotide
gaaauuaacuuuuaaauguuuauag

SEQ ID NO: 1561 - RNA, 25 nt, Artificial Sequence
  Description of Artificial Sequence: Synthetic oligonucleotide
aaauuaacuuuuaaauguuuauagg

SEQ ID NO: 1562 - DNA, 25 bp, Artificial Sequence
  Description of Artificial Sequence: Synthetic oligonucleotide
  Description of Combined DNA/RNA Molecule: Synthetic oligonucleotide
uuaacuuuuaaauguuuauaggagt

SEQ ID NO: 1563 - DNA, 25 bp, Artificial Sequence
  Description of Artificial Sequence: Synthetic oligonucleotide
  Description of Combined DNA/RNA Molecule: Synthetic oligonucleotide
cuuuuaaauguuuauaggaguaugt

SEQ ID NO: 1564 - DNA, 25 bp, Artificial Sequence
  Description of Artificial Sequence: Synthetic oligonucleotide
  Description of Combined DNA/RNA Molecule: Synthetic oligonucleotide
uaaauguuuauaggaguaugugctg

SEQ ID NO: 1565 - DNA, 25 bp, Artificial Sequence
  Description of Artificial Sequence: Synthetic oligonucleotide
  Description of Combined DNA/RNA Molecule: Synthetic oligonucleotide
aaauguuuauaggaguaugugcugt

SEQ ID NO: 1566 - DNA, 25 bp, Artificial Sequence
  Description of Artificial Sequence: Synthetic oligonucleotide
  Description of Combined DNA/RNA Molecule: Synthetic oligonucleotide
ugugaagugaucuaaaauuuguaat

SEQ ID NO: 1567 - DNA, 25 bp, Artificial Sequence
  Description of Artificial Sequence: Synthetic oligonucleotide
  Description of Combined DNA/RNA Molecule: Synthetic oligonucleotide
ugaagugaucuaaaauuuguaauat

SEQ ID NO: 1568 - DNA, 25 bp, Artificial Sequence
  Description of Artificial Sequence: Synthetic oligonucleotide
  Description of Combined DNA/RNA Molecule: Synthetic oligonucleotide
gaagugaucuaaaauuuguaauatt

SEQ ID NO: 1569 - DNA, 25 bp, Artificial Sequence
  Description of Artificial Sequence: Synthetic oligonucleotide
  Description of Combined DNA/RNA Molecule: Synthetic oligonucleotide
aagugaucuaaaauuuguaauautt

SEQ ID NO: 1570 - DNA, 25 bp, Artificial Sequence
  Description of Artificial Sequence: Synthetic oligonucleotide
  Description of Combined DNA/RNA Molecule: Synthetic oligonucleotide
agugaucuaaaauuuguaauauutt

SEQ ID NO: 1571 - DNA, 25 bp, Artificial Sequence
  Description of Artificial Sequence: Synthetic oligonucleotide
  Description of Combined DNA/RNA Molecule: Synthetic oligonucleotide
gugaucuaaaauuuguaauauuutt

SEQ ID NO: 1572 - DNA, 25 bp, Artificial Sequence
  Description of Artificial Sequence: Synthetic oligonucleotide
  Description of Combined DNA/RNA Molecule: Synthetic oligonucleotide
ugaucuaaaauuuguaauauuuutg

SEQ ID NO: 1573 - DNA, 25 bp, Artificial Sequence
  Description of Artificial Sequence: Synthetic oligonucleotide
  Description of Combined DNA/RNA Molecule: Synthetic oligonucleotide
cuaaaauuuguaauauuuuugucat

SEQ ID NO: 1574 - DNA, 25 bp, Artificial Sequence
  Description of Artificial Sequence: Synthetic oligonucleotide
  Description of Combined DNA/RNA Molecule: Synthetic oligonucleotide
uaaaauuuguaauauuuuugucatg

SEQ ID NO: 1575 - DNA, 25 bp, Artificial Sequence
  Description of Artificial Sequence: Synthetic oligonucleotide
  Description of Combined DNA/RNA Molecule: Synthetic oligonucleotide
auuuguaauauuuuugucaugaact

SEQ ID NO: 1576 - DNA, 25 bp, Artificial Sequence
  Description of Artificial Sequence: Synthetic oligonucleotide
  Description of Combined DNA/RNA Molecule: Synthetic oligonucleotide
uuuguaauauuuuugucaugaactg

SEQ ID NO: 1577 - DNA, 25 bp, Artificial Sequence
  Description of Artificial Sequence: Synthetic oligonucleotide
  Description of Combined DNA/RNA Molecule: Synthetic oligonucleotide
uuguaauauuuuugucaugaacugt

SEQ ID NO: 1578 - DNA, 25 bp, Artificial Sequence
  Description of Artificial Sequence: Synthetic oligonucleotide
  Description of Combined DNA/RNA Molecule: Synthetic oligonucleotide
aauauuuuugucaugaacuguacta

SEQ ID NO: 1579 - RNA, 25 nt, Artificial Sequence
  Description of Artificial Sequence: Synthetic oligonucleotide
auauuuuugucaugaacuguacuac

SEQ ID NO: 1580 - DNA, 25 bp, Artificial Sequence
  Description of Artificial Sequence: Synthetic oligonucleotide
  Description of Combined DNA/RNA Molecule: Synthetic oligonucleotide
cuguacuacuccuaauuauuguaat

SEQ ID NO: 1581 - DNA, 25 bp, Artificial Sequence
  Description of Artificial Sequence: Synthetic oligonucleotide
  Description of Combined DNA/RNA Molecule: Synthetic oligonucleotide
uguacuacuccuaauuauuguaatg

SEQ ID NO: 1582 - DNA, 25 bp, Artificial Sequence
  Description of Artificial Sequence: Synthetic oligonucleotide
  Description of Combined DNA/RNA Molecule: Synthetic oligonucleotide
cuaauuauuguaauguaauaaaaat

SEQ ID NO: 1583 - DNA, 25 bp, Artificial Sequence
  Description of Artificial Sequence: Synthetic oligonucleotide
  Description of Combined DNA/RNA Molecule: Synthetic oligonucleotide
uaauuauuguaauguaauaaaaata

SEQ ID NO: 1584 - DNA, 25 bp, Artificial Sequence
  Description of Artificial Sequence: Synthetic oligonucleotide
  Description of Combined DNA/RNA Molecule: Synthetic oligonucleotide
auuauuguaauguaauaaaaauagt

SEQ ID NO: 1585 - DNA, 25 bp, Artificial Sequence
  Description of Artificial Sequence: Synthetic oligonucleotide
  Description of Combined DNA/RNA Molecule: Synthetic oligonucleotide
uauuguaauguaauaaaaauaguta

SEQ ID NO: 1586 - RNA, 25 nt, Artificial Sequence
  Description of Artificial Sequence: Synthetic oligonucleotide
auuguaauguaauaaaaauaguuac

SEQ ID NO: 1587 - RNA, 25 nt, Artificial Sequence
  Description of Artificial Sequence: Synthetic oligonucleotide
uguaauguaauaaaaauaguuacag

SEQ ID NO: 1588 - DNA, 25 bp, Artificial Sequence
  Description of Artificial Sequence: Synthetic oligonucleotide
  Description of Combined DNA/RNA Molecule: Synthetic oligonucleotide
guaauguaauaaaaauaguuacagt

SEQ ID NO: 1589 - RNA, 25 nt, Artificial Sequence
  Description of Artificial Sequence: Synthetic oligonucleotide
uguaauaaaaauaguuacagugaca

SEQ ID NO: 1590 - RNA, 25 nt, Artificial Sequence
  Description of Artificial Sequence: Synthetic oligonucleotide
guaauaaaaauaguuacagugacaa

SEQ ID NO: 1591 - RNA, 25 nt, Artificial Sequence
  Description of Artificial Sequence: Synthetic oligonucleotide
uaauaaaaauaguuacagugacaaa

SEQ ID NO: 1592 - RNA, 25 nt, Artificial Sequence
  Description of Artificial Sequence: Synthetic oligonucleotide
auaguuacagugacaaaaaaaaaaa

SEQ ID NO: 1593 - RNA, 25 nt, Artificial Sequence
  Description of Artificial Sequence: Synthetic oligonucleotide
uaguuacagugacaaaaaaaaaaaa

SEQ ID NO: 1594 - RNA, 25 nt, Artificial Sequence
  Description of Artificial Sequence: Synthetic oligonucleotide
guuacagugacaaaaaaaaaaaaaa

SEQ ID NO: 1595 - DNA, 27 bp, Homo sapiens
tgctgaaaatgactgaatataaacttg

SEQ ID NO: 1596 - DNA, 27 bp, Homo sapiens
aaatgactgaatataaacttgtggtag

SEQ ID NO: 1597 - DNA, 27 bp, Homo sapiens
gactgaatataaacttgtggtagttgg

SEQ ID NO: 1598 - DNA, 27 bp, Homo sapiens
agctaattcagaatcattttgtggacg

SEQ ID NO: 1599 - DNA, 27 bp, Homo sapiens
acgaatatgatccaacaatagaggatt

SEQ ID NO: 1600 - DNA, 27 bp, Homo sapiens
agcaagtagtaattgatggagaaacct

SEQ ID NO: 1601 - DNA, 27 bp, Homo sapiens
ggagggctttctttgtgtatttgccat

SEQ ID NO: 1602 - DNA, 27 bp, Homo sapiens
tctttgtgtatttgccataaataatac

SEQ ID NO: 1603 - DNA, 27 bp, Homo sapiens
ctttgtgtatttgccataaataatact

SEQ ID NO: 1604 - DNA, 27 bp, Homo sapiens
tttgtgtatttgccataaataatacta

SEQ ID NO: 1605 - DNA, 27 bp, Homo sapiens
ttgtgtatttgccataaataatactaa

SEQ ID NO: 1606 - DNA, 27 bp, Homo sapiens
gtatttgccataaataatactaaatca

SEQ ID NO: 1607 - DNA, 27 bp, Homo sapiens
tatttgccataaataatactaaatcat

SEQ ID NO: 1608 - DNA, 27 bp, Homo sapiens
ccataaataatactaaatcatttgaag

SEQ ID NO: 1609 - DNA, 27 bp, Homo sapiens
cataaataatactaaatcatttgaaga

SEQ ID NO: 1610 - DNA, 27 bp, Homo sapiens
taaataatactaaatcatttgaagata

SEQ ID NO: 1611 - DNA, 27 bp, Homo sapiens
aaataatactaaatcatttgaagatat

SEQ ID NO: 1612 - DNA, 27 bp, Homo sapiens
aataatactaaatcatttgaagatatt

SEQ ID NO: 1613 - DNA, 27 bp, Homo sapiens
ataatactaaatcatttgaagatattc

SEQ ID NO: 1614 - DNA, 27 bp, Homo sapiens
atttgaagatattcaccattatagaga

SEQ ID NO: 1615 - DNA, 27 bp, Homo sapiens
ttgaagatattcaccattatagagaac

SEQ ID NO: 1616 - DNA, 27 bp, Homo sapiens
tgaagatattcaccattatagagaaca

SEQ ID NO: 1617 - DNA, 27 bp, Homo sapiens
gaagatattcaccattatagagaacaa

SEQ ID NO: 1618 - DNA, 27 bp, Homo sapiens
aagatattcaccattatagagaacaaa

SEQ ID NO: 1619 - DNA, 27 bp, Homo sapiens
ccattatagagaacaaattaaaagagt

SEQ ID NO: 1620 - DNA, 27 bp, Homo sapiens
attatagagaacaaattaaaagagtta

SEQ ID NO: 1621 - DNA, 27 bp, Homo sapiens
ttatagagaacaaattaaaagagttaa

SEQ ID NO: 1622 - DNA, 27 bp, Homo sapiens
tatagagaacaaattaaaagagttaag

SEQ ID NO: 1623 - DNA, 27 bp, Homo sapiens
atagagaacaaattaaaagagttaagg

SEQ ID NO: 1624 - DNA, 27 bp, Homo sapiens
ctagtaggaaataaatgtgatttgcct

SEQ ID NO: 1625 - DNA, 27 bp, Homo sapiens
tagtaggaaataaatgtgatttgcctt

SEQ ID NO: 1626 - DNA, 27 bp, Homo sapiens
aagaagttatggaattccttttattga

SEQ ID NO: 1627 - DNA, 27 bp, Homo sapiens
aagttatggaattccttttattgaaac

SEQ ID NO: 1628 - DNA, 27 bp, Homo sapiens
agttatggaattccttttattgaaaca

SEQ ID NO: 1629 - DNA, 27 bp, Homo sapiens
gttatggaattccttttattgaaacat

SEQ ID NO: 1630 - DNA, 27 bp, Homo sapiens
ttatggaattccttttattgaaacatc

SEQ ID NO: 1631 - DNA, 27 bp, Homo sapiens
tggaggatgctttttatacattggtga

SEQ ID NO: 1632 - DNA, 27 bp, Homo sapiens
gaggatgctttttatacattggtgagg

SEQ ID NO: 1633 - DNA, 27 bp, Homo sapiens
acagattgaaaaaaatcagcaaagaag

SEQ ID NO: 1634 - DNA, 27 bp, Homo sapiens
cagattgaaaaaaatcagcaaagaaga

SEQ ID NO: 1635 - DNA, 27 bp, Homo sapiens
gattgaaaaaaatcagcaaagaagaaa

SEQ ID NO: 1636 - DNA, 27 bp, Homo sapiens
attgaaaaaaatcagcaaagaagaaaa

SEQ ID NO: 1637 - DNA, 27 bp, Homo sapiens
ttgaaaaaaatcagcaaagaagaaaag

SEQ ID NO: 1638 - DNA, 27 bp, Homo sapiens
tgaaaaaaatcagcaaagaagaaaaga

SEQ ID NO: 1639 - DNA, 27 bp, Homo sapiens
tcctggctgtgtgaaaattaaaaaatg

SEQ ID NO: 1640 - DNA, 27 bp, Homo sapiens
ggctgtgtgaaaattaaaaaatgcatt

SEQ ID NO: 1641 - DNA, 27 bp, Homo sapiens
gtgtgaaaattaaaaaatgcattataa

SEQ ID NO: 1642 - DNA, 27 bp, Homo sapiens
tgtgaaaattaaaaaatgcattataat

SEQ ID NO: 1643 - DNA, 27 bp, Homo sapiens
gtgaaaattaaaaaatgcattataatg

SEQ ID NO: 1644 - DNA, 27 bp, Homo sapiens
tgaaaattaaaaaatgcattataatgt

SEQ ID NO: 1645 - DNA, 27 bp, Homo sapiens
aaaattaaaaaatgcattataatgtaa

SEQ ID NO: 1646 - DNA, 27 bp, Homo sapiens
aaattaaaaaatgcattataatgtaat

SEQ ID NO: 1647 - DNA, 27 bp, Homo sapiens
aattaaaaaatgcattataatgtaatc

SEQ ID NO: 1648 - DNA, 27 bp, Homo sapiens
attaaaaaatgcattataatgtaatct

SEQ ID NO: 1649 - DNA, 27 bp, Homo sapiens
taaaaaatgcattataatgtaatctgg

SEQ ID NO: 1650 - DNA, 27 bp, Homo sapiens
tgcattataatgtaatctgggtgttga

SEQ ID NO: 1651 - DNA, 27 bp, Homo sapiens
ttcgagaaattcgaaaacataaagaaa

SEQ ID NO: 1652 - DNA, 27 bp, Homo sapiens
tcgagaaattcgaaaacataaagaaaa

SEQ ID NO: 1653 - DNA, 27 bp, Homo sapiens
cgagaaattcgaaaacataaagaaaag

SEQ ID NO: 1654 - DNA, 27 bp, Homo sapiens
gaaattcgaaaacataaagaaaagatg

SEQ ID NO: 1655 - DNA, 27 bp, Homo sapiens
tcgaaaacataaagaaaagatgagcaa

SEQ ID NO: 1656 - DNA, 27 bp, Homo sapiens
cgaaaacataaagaaaagatgagcaaa

SEQ ID NO: 1657 - DNA, 27 bp, Homo sapiens
aaagatggtaaaaagaagaaaaagaag

SEQ ID NO: 1658 - DNA, 27 bp, Homo sapiens
aagatggtaaaaagaagaaaaagaagt

SEQ ID NO: 1659 - DNA, 27 bp, Homo sapiens
gatggtaaaaagaagaaaaagaagtca

SEQ ID NO: 1660 - DNA, 27 bp, Homo sapiens
atggtaaaaagaagaaaaagaagtcaa

SEQ ID NO: 1661 - DNA, 27 bp, Homo sapiens
aaaaagaagaaaaagaagtcaaagaca

SEQ ID NO: 1662 - DNA, 27 bp, Homo sapiens
aaaagaagaaaaagaagtcaaagacaa

SEQ ID NO: 1663 - DNA, 27 bp, Homo sapiens
aaagaagaaaaagaagtcaaagacaaa

SEQ ID NO: 1664 - DNA, 27 bp, Homo sapiens
tcaaagacaaagtgtgtaattatgtaa

SEQ ID NO: 1665 - DNA, 27 bp, Homo sapiens
caaagacaaagtgtgtaattatgtaaa

SEQ ID NO: 1666 - DNA, 27 bp, Homo sapiens
gacaaagtgtgtaattatgtaaataca

SEQ ID NO: 1667 - DNA, 27 bp, Homo sapiens
caaagtgtgtaattatgtaaatacaat

SEQ ID NO: 1668 - DNA, 27 bp, Homo sapiens
gtgtgtaattatgtaaatacaatttgt

SEQ ID NO: 1669 - DNA, 27 bp, Homo sapiens
gtgtaattatgtaaatacaatttgtac

SEQ ID NO: 1670 - DNA, 27 bp, Homo sapiens
gtaattatgtaaatacaatttgtactt

SEQ ID NO: 1671 - DNA, 27 bp, Homo sapiens
taattatgtaaatacaatttgtacttt

SEQ ID NO: 1672 - DNA, 27 bp, Homo sapiens
tatgtaaatacaatttgtacttttttc

SEQ ID NO: 1673 - DNA, 27 bp, Homo sapiens
atgtaaatacaatttgtacttttttct

SEQ ID NO: 1674 - DNA, 27 bp, Homo sapiens
gtaaatacaatttgtacttttttctta

SEQ ID NO: 1675 - DNA, 27 bp, Homo sapiens
acaatttgtacttttttcttaaggcat

SEQ ID NO: 1676 - DNA, 27 bp, Homo sapiens
caatttgtacttttttcttaaggcata

SEQ ID NO: 1677 - DNA, 27 bp, Homo sapiens
tactagtacaagtggtaatttttgtac

SEQ ID NO: 1678 - DNA, 27 bp, Homo sapiens
actagtacaagtggtaatttttgtaca

SEQ ID NO: 1679 - DNA, 27 bp, Homo sapiens
acaagtggtaatttttgtacattacac

SEQ ID NO: 1680 - DNA, 27 bp, Homo sapiens
caagtggtaatttttgtacattacact

SEQ ID NO: 1681 - DNA, 27 bp, Homo sapiens
taatttttgtacattacactaaattat

SEQ ID NO: 1682 - DNA, 27 bp, Homo sapiens
aatttttgtacattacactaaattatt

SEQ ID NO: 1683 - DNA, 27 bp, Homo sapiens
atttttgtacattacactaaattatta

SEQ ID NO: 1684 - DNA, 27 bp, Homo sapiens
tttttgtacattacactaaattattag

SEQ ID NO: 1685 - DNA, 27 bp, Homo sapiens
ttttgtacattacactaaattattagc

SEQ ID NO: 1686 - DNA, 27 bp, Homo sapiens
cactaaattattagcatttgttttagc

SEQ ID NO: 1687 - DNA, 27 bp, Homo sapiens
ctaaattattagcatttgttttagcat

SEQ ID NO: 1688 - DNA, 27 bp, Homo sapiens
taaattattagcatttgttttagcatt

SEQ ID NO: 1689 - DNA, 27 bp, Homo sapiens
tattagcatttgttttagcattaccta

SEQ ID NO: 1690 - DNA, 27 bp, Homo sapiens
catttgttttagcattacctaattttt

SEQ ID NO: 1691 - DNA, 27 bp, Homo sapiens
atttgttttagcattacctaatttttt

SEQ ID NO: 1692 - DNA, 27 bp, Homo sapiens
ttgttttagcattacctaatttttttc

SEQ ID NO: 1693 - DNA, 27 bp, Homo sapiens
tgttttagcattacctaatttttttcc

SEQ ID NO: 1694 - DNA, 27 bp, Homo sapiens
gttttagcattacctaatttttttcct

SEQ ID NO: 1695 - DNA, 27 bp, Homo sapiens
ttttagcattacctaatttttttcctg

SEQ ID NO: 1696 - DNA, 27 bp, Homo sapiens
gactgttagcttttaccttaaatgctt

SEQ ID NO: 1697 - DNA, 27 bp, Homo sapiens
actgttagcttttaccttaaatgctta

SEQ ID NO: 1698 - DNA, 27 bp, Homo sapiens
agcttttaccttaaatgcttattttaa

SEQ ID NO: 1699 - DNA, 27 bp, Homo sapiens
gcttttaccttaaatgcttattttaaa

SEQ ID NO: 1700 - DNA, 27 bp, Homo sapiens
cttttaccttaaatgcttattttaaaa

SEQ ID NO: 1701 - DNA, 27 bp, Homo sapiens
ccttaaatgcttattttaaaatgacag

SEQ ID NO: 1702 - DNA, 27 bp, Homo sapiens
ccttaaatgcttattttaaaatgacag

SEQ ID NO: 1703 - DNA, 27 bp, Homo sapiens
cttaaatgcttattttaaaatgacagt

SEQ ID NO: 1704 - DNA, 27 bp, Homo sapiens
tgcttattttaaaatgacagtggaagt

SEQ ID NO: 1705 - DNA, 27 bp, Homo sapiens
cttattttaaaatgacagtggaagttt

SEQ ID NO: 1706 - DNA, 27 bp, Homo sapiens
gtggaagtttttttttcctctaagtgc

SEQ ID NO: 1707 - DNA, 27 bp, Homo sapiens
ggaagtttttttttcctctaagtgcca

SEQ ID NO: 1708 - DNA, 27 bp, Homo sapiens
gaagtttttttttcctctaagtgccag

SEQ ID NO: 1709 - DNA, 27 bp, Homo sapiens
ttttggtttttgaactagcaatgcctg

SEQ ID NO: 1710 - DNA, 27 bp, Homo sapiens
gcctgtgaaaaagaaactgaataccta

SEQ ID NO: 1711 - DNA, 27 bp, Homo sapiens
aaaaagaaactgaatacctaagatttc

SEQ ID NO: 1712 - DNA, 27 bp, Homo sapiens
aaaagaaactgaatacctaagatttct

SEQ ID NO: 1713 - DNA, 27 bp, Homo sapiens
aactgaatacctaagatttctgtcttg

SEQ ID NO: 1714 - DNA, 27 bp, Homo sapiens
tgcagttgattacttcttatttttctt

SEQ ID NO: 1715 - DNA, 27 bp, Homo sapiens
gcagttgattacttcttatttttctta

SEQ ID NO: 1716 - DNA, 27 bp, Homo sapiens
ttgattacttcttatttttcttaccaa

SEQ ID NO: 1717 - DNA, 27 bp, Homo sapiens
ttcttatttttcttaccaattgtgaat

SEQ ID NO: 1718 - DNA, 27 bp, Homo sapiens
tcttatttttcttaccaattgtgaatg

SEQ ID NO: 1719 - DNA, 27 bp, Homo sapiens
cttatttttcttaccaattgtgaatgt

SEQ ID NO: 1720 - DNA, 27 bp, Homo sapiens
atgttggtgtgaaacaaattaatgaag

SEQ ID NO: 1721 - DNA, 27 bp, Homo sapiens
ttggtgtgaaacaaattaatgaagctt

SEQ ID NO: 1722 - DNA, 27 bp, Homo sapiens
tggtgtgaaacaaattaatgaagcttt

SEQ ID NO: 1723 - DNA, 27 bp, Homo sapiens
aacaaattaatgaagcttttgaatcat

SEQ ID NO: 1724 - DNA, 27 bp, Homo sapiens
acaaattaatgaagcttttgaatcatc

SEQ ID NO: 1725 - DNA, 27 bp, Homo sapiens
tctgtgttttatctagtcacataaatg

SEQ ID NO: 1726 - DNA, 27 bp, Homo sapiens
ctgtgttttatctagtcacataaatgg

SEQ ID NO: 1727 - DNA, 27 bp, Homo sapiens
tgttttatctagtcacataaatggatt

SEQ ID NO: 1728 - DNA, 27 bp, Homo sapiens
gttttatctagtcacataaatggatta

SEQ ID NO: 1729 - DNA, 27 bp, Homo sapiens
atctagtcacataaatggattaattac

SEQ ID NO: 1730 - DNA, 27 bp, Homo sapiens
tctagtcacataaatggattaattact

SEQ ID NO: 1731 - DNA, 27 bp, Homo sapiens
cataaatggattaattactaatttcag

SEQ ID NO: 1732 - DNA, 27 bp, Homo sapiens
ataaatggattaattactaatttcagt

SEQ ID NO: 1733 - DNA, 27 bp, Homo sapiens
tggattaattactaatttcagttgaga

SEQ ID NO: 1734 - DNA, 27 bp, Homo sapiens
gattaattactaatttcagttgagacc

SEQ ID NO: 1735 - DNA, 27 bp, Homo sapiens
attaattactaatttcagttgagacct

SEQ ID NO: 1736 - DNA, 27 bp, Homo sapiens
ttaattactaatttcagttgagacctt

SEQ ID NO: 1737 - DNA, 27 bp, Homo sapiens
taattggtttttactgaaacattgagg

SEQ ID NO: 1738 - DNA, 27 bp, Homo sapiens
tggtttttactgaaacattgagggaac

SEQ ID NO: 1739 - DNA, 27 bp, Homo sapiens
ggtttttactgaaacattgagggaaca

SEQ ID NO: 1740 - DNA, 27 bp, Homo sapiens
attgagggaacacaaatttatgggctt

SEQ ID NO: 1741 - DNA, 27 bp, Homo sapiens
ttgagggaacacaaatttatgggcttc

SEQ ID NO: 1742 - DNA, 27 bp, Homo sapiens
tgatgaatgtaaagttacactgttcac

SEQ ID NO: 1743 - DNA, 27 bp, Homo sapiens
gatgaatgtaaagttacactgttcaca

SEQ ID NO: 1744 - DNA, 27 bp, Homo sapiens
ccaaaatattatattttttctataaaa

SEQ ID NO: 1745 - DNA, 27 bp, Homo sapiens
caaaatattatattttttctataaaaa

SEQ ID NO: 1746 - DNA, 27 bp, Homo sapiens
aaaatattatattttttctataaaaag

SEQ ID NO: 1747 - DNA, 27 bp, Homo sapiens
aaatattatattttttctataaaaaga

SEQ ID NO: 1748 - DNA, 27 bp, Homo sapiens
atattatattttttctataaaaagaaa

SEQ ID NO: 1749 - DNA, 27 bp, Homo sapiens
tattatattttttctataaaaagaaaa

SEQ ID NO: 1750 - DNA, 27 bp, Homo sapiens
attatattttttctataaaaagaaaaa

SEQ ID NO: 1751 - DNA, 27 bp, Homo sapiens
ttatattttttctataaaaagaaaaaa

SEQ ID NO: 1752 - DNA, 27 bp, Homo sapiens
tatattttttctataaaaagaaaaaaa

SEQ ID NO: 1753 - DNA, 27 bp, Homo sapiens
atattttttctataaaaagaaaaaaat

SEQ ID NO: 1754 - DNA, 27 bp, Homo sapiens
tattttttctataaaaagaaaaaaatg

SEQ ID NO: 1755 - DNA, 27 bp, Homo sapiens
attttttctataaaaagaaaaaaatgg

SEQ ID NO: 1756 - DNA, 27 bp, Homo sapiens
ttctataaaaagaaaaaaatggaaaaa

SEQ ID NO: 1757 - DNA, 27 bp, Homo sapiens
tctataaaaagaaaaaaatggaaaaaa

SEQ ID NO: 1758 - DNA, 27 bp, Homo sapiens
tataaaaagaaaaaaatggaaaaaaat

SEQ ID NO: 1759 - DNA, 27 bp, Homo sapiens
ataaaaagaaaaaaatggaaaaaaatt

SEQ ID NO: 1760 - DNA, 27 bp, Homo sapiens
taaaaagaaaaaaatggaaaaaaatta

SEQ ID NO: 1761 - DNA, 27 bp, Homo sapiens
aaaaagaaaaaaatggaaaaaaattac

SEQ ID NO: 1762 - DNA, 27 bp, Homo sapiens
aaaagaaaaaaatggaaaaaaattaca

SEQ ID NO: 1763 - DNA, 27 bp, Homo sapiens
aaagaaaaaaatggaaaaaaattacaa

SEQ ID NO: 1764 - DNA, 27 bp, Homo sapiens
aagaaaaaaatggaaaaaaattacaag

SEQ ID NO: 1765 - DNA, 27 bp, Homo sapiens
aaaaaatggaaaaaaattacaaggcaa

SEQ ID NO: 1766 - DNA, 27 bp, Homo sapiens
aaaaatggaaaaaaattacaaggcaat

SEQ ID NO: 1767 - DNA, 27 bp, Homo sapiens
tggaaaaaaattacaaggcaatggaaa

SEQ ID NO: 1768 - DNA, 27 bp, Homo sapiens
ggaaaaaaattacaaggcaatggaaac

SEQ ID NO: 1769 - DNA, 27 bp, Homo sapiens
gaaaaaaattacaaggcaatggaaact

SEQ ID NO: 1770 - DNA, 27 bp, Homo sapiens
gccatttccttttcacattagataaat

SEQ ID NO: 1771 - DNA, 27 bp, Homo sapiens
tccttttcacattagataaattactat

SEQ ID NO: 1772 - DNA, 27 bp, Homo sapiens
cacattagataaattactataaagact

SEQ ID NO: 1773 - DNA, 27 bp, Homo sapiens
acattagataaattactataaagactc

SEQ ID NO: 1774 - DNA, 27 bp, Homo sapiens
cattagataaattactataaagactcc

SEQ ID NO: 1775 - DNA, 27 bp, Homo sapiens
agtatgaaatggggattattatagcaa

SEQ ID NO: 1776 - DNA, 27 bp, Homo sapiens
tggggattattatagcaaccattttgg

SEQ ID NO: 1777 - DNA, 27 bp, Homo sapiens
ggctatatttacatgctactaaatttt

SEQ ID NO: 1778 - DNA, 27 bp, Homo sapiens
gctatatttacatgctactaaattttt

SEQ ID NO: 1779 - DNA, 27 bp, Homo sapiens
ctatatttacatgctactaaattttta

SEQ ID NO: 1780 - DNA, 27 bp, Homo sapiens
tatatttacatgctactaaatttttat

SEQ ID NO: 1781 - DNA, 27 bp, Homo sapiens
atatttacatgctactaaatttttata

SEQ ID NO: 1782 - DNA, 27 bp, Homo sapiens
tacatgctactaaatttttataataat

SEQ ID NO: 1783 - DNA, 27 bp, Homo sapiens
tactaaatttttataataattgaaaag

SEQ ID NO: 1784 - DNA, 27 bp, Homo sapiens
actaaatttttataataattgaaaaga

SEQ ID NO: 1785 - DNA, 27 bp, Homo sapiens
taaatttttataataattgaaaagatt

SEQ ID NO: 1786 - DNA, 27 bp, Homo sapiens
aaatttttataataattgaaaagattt

SEQ ID NO: 1787 - DNA, 27 bp, Homo sapiens
aatttttataataattgaaaagatttt

SEQ ID NO: 1788 - DNA, 27 bp, Homo sapiens
atttttataataattgaaaagatttta

SEQ ID NO: 1789 - DNA, 27 bp, Homo sapiens
tttttataataattgaaaagattttaa

SEQ ID NO: 1790 - DNA, 27 bp, Homo sapiens
ttttataataattgaaaagattttaac

SEQ ID NO: 1791 - DNA, 27 bp, Homo sapiens
tttataataattgaaaagattttaaca

SEQ ID NO: 1792 - DNA, 27 bp, Homo sapiens
ttataataattgaaaagattttaacaa

SEQ ID NO: 1793 - DNA, 27 bp, Homo sapiens
tataataattgaaaagattttaacaag

SEQ ID NO: 1794 - DNA, 27 bp, Homo sapiens
ataattgaaaagattttaacaagtata

SEQ ID NO: 1795 - DNA, 27 bp, Homo sapiens
taattgaaaagattttaacaagtataa

SEQ ID NO: 1796 - DNA, 27 bp, Homo sapiens
attgaaaagattttaacaagtataaaa

SEQ ID NO: 1797 - DNA, 27 bp, Homo sapiens
ttgaaaagattttaacaagtataaaaa

SEQ ID NO: 1798 - DNA, 27 bp, Homo sapiens
tgaaaagattttaacaagtataaaaaa

SEQ ID NO: 1799 - DNA, 27 bp, Homo sapiens
gaaaagattttaacaagtataaaaaat

SEQ ID NO: 1800 - DNA, 27 bp, Homo sapiens
aaaagattttaacaagtataaaaaatt

SEQ ID NO: 1801 - DNA, 27 bp, Homo sapiens
aaagattttaacaagtataaaaaattc

SEQ ID NO: 1802 - DNA, 27 bp, Homo sapiens
aagattttaacaagtataaaaaattct

SEQ ID NO: 1803 - DNA, 27 bp, Homo sapiens
agattttaacaagtataaaaaattctc

SEQ ID NO: 1804 - DNA, 27 bp, Homo sapiens
gattttaacaagtataaaaaattctca

SEQ ID NO: 1805 - DNA, 27 bp, Homo sapiens
acaagtataaaaaattctcataggaat

SEQ ID NO: 1806 - DNA, 27 bp, Homo sapiens
caagtataaaaaattctcataggaatt

SEQ ID NO: 1807 - DNA, 27 bp, Homo sapiens
aagtataaaaaattctcataggaatta

SEQ ID NO: 1808 - DNA, 27 bp, Homo sapiens
agtataaaaaattctcataggaattaa

SEQ ID NO: 1809 - DNA, 27 bp, Homo sapiens
gtataaaaaattctcataggaattaaa

SEQ ID NO: 1810 - DNA, 27 bp, Homo sapiens
tataaaaaattctcataggaattaaat

SEQ ID NO: 1811 - DNA, 27 bp, Homo sapiens
ataaaaaattctcataggaattaaatg

SEQ ID NO: 1812 - DNA, 27 bp, Homo sapiens
taaaaaattctcataggaattaaatgt

SEQ ID NO: 1813 - DNA, 27 bp, Homo sapiens
aaaaattctcataggaattaaatgtag

SEQ ID NO: 1814 - DNA, 27 bp, Homo sapiens
aaaattctcataggaattaaatgtagt

SEQ ID NO: 1815 - DNA, 27 bp, Homo sapiens
ctctttcatagtataactttaaatctt

SEQ ID NO: 1816 - DNA, 27 bp, Homo sapiens
tcatagtataactttaaatcttttctt

SEQ ID NO: 1817 - DNA, 27 bp, Homo sapiens
catagtataactttaaatcttttcttc

SEQ ID NO: 1818 - DNA, 27 bp, Homo sapiens
tttaaatcttttcttcaacttgagtct

SEQ ID NO: 1819 - DNA, 27 bp, Homo sapiens
ttaaatcttttcttcaacttgagtctt

SEQ ID NO: 1820 - DNA, 27 bp, Homo sapiens
aacttgagtctttgaagatagttttaa

SEQ ID NO: 1821 - DNA, 27 bp, Homo sapiens
cttgagtctttgaagatagttttaatt

SEQ ID NO: 1822 - DNA, 27 bp, Homo sapiens
ttgagtctttgaagatagttttaattc

SEQ ID NO: 1823 - DNA, 27 bp, Homo sapiens
aagatagttttaattctgcttgtgaca

SEQ ID NO: 1824 - DNA, 27 bp, Homo sapiens
agatagttttaattctgcttgtgacat

SEQ ID NO: 1825 - DNA, 27 bp, Homo sapiens
gatagttttaattctgcttgtgacatt

SEQ ID NO: 1826 - DNA, 27 bp, Homo sapiens
tgcttgtgacattaaaagattatttgg

SEQ ID NO: 1827 - DNA, 27 bp, Homo sapiens
agcattgcttttgtttcttaagaaaac

SEQ ID NO: 1828 - DNA, 27 bp, Homo sapiens
gcattgcttttgtttcttaagaaaaca

SEQ ID NO: 1829 - DNA, 27 bp, Homo sapiens
cttttgtttcttaagaaaacaaactct

SEQ ID NO: 1830 - DNA, 27 bp, Homo sapiens
ttcttaagaaaacaaactcttttttaa

SEQ ID NO: 1831 - DNA, 27 bp, Homo sapiens
tcttaagaaaacaaactcttttttaaa

SEQ ID NO: 1832 - DNA, 27 bp, Homo sapiens
cttaagaaaacaaactcttttttaaaa

SEQ ID NO: 1833 - DNA, 27 bp, Homo sapiens
ttaagaaaacaaactcttttttaaaaa

SEQ ID NO: 1834 - DNA, 27 bp, Homo sapiens
taagaaaacaaactcttttttaaaaat

SEQ ID NO: 1835 - DNA, 27 bp, Homo sapiens
aagaaaacaaactcttttttaaaaatt

SEQ ID NO: 1836 - DNA, 27 bp, Homo sapiens
agaaaacaaactcttttttaaaaatta

SEQ ID NO: 1837 - DNA, 27 bp, Homo sapiens
aacaaactcttttttaaaaattacttt

SEQ ID NO: 1838 - DNA, 27 bp, Homo sapiens
ctcttttttaaaaattacttttaaata

SEQ ID NO: 1839 - DNA, 27 bp, Homo sapiens
tcttttttaaaaattacttttaaatat

SEQ ID NO: 1840 - DNA, 27 bp, Homo sapiens
cttttttaaaaattacttttaaatatt

SEQ ID NO: 1841 - DNA, 27 bp, Homo sapiens
ttttttaaaaattacttttaaatatta

SEQ ID NO: 1842 - DNA, 27 bp, Homo sapiens
tttttaaaaattacttttaaatattaa

SEQ ID NO: 1843 - DNA, 27 bp, Homo sapiens
ttttaaaaattacttttaaatattaac

SEQ ID NO: 1844 - DNA, 27 bp, Homo sapiens
tttaaaaattacttttaaatattaact

SEQ ID NO: 1845 - DNA, 27 bp, Homo sapiens
ttaaaaattacttttaaatattaactc

SEQ ID NO: 1846 - DNA, 27 bp, Homo sapiens
taaaaattacttttaaatattaactca

SEQ ID NO: 1847 - DNA, 27 bp, Homo sapiens
tacttttaaatattaactcaaaagttg

SEQ ID NO: 1848 - DNA, 27 bp, Homo sapiens
acttttaaatattaactcaaaagttga

SEQ ID NO: 1849 - DNA, 27 bp, Homo sapiens
ttttaaatattaactcaaaagttgaga

SEQ ID NO: 1850 - DNA, 27 bp, Homo sapiens
ttaaatattaactcaaaagttgagatt

SEQ ID NO: 1851 - DNA, 27 bp, Homo sapiens
taaatattaactcaaaagttgagattt

SEQ ID NO: 1852 - DNA, 27 bp, Homo sapiens
aaatattaactcaaaagttgagatttt

SEQ ID NO: 1853 - DNA, 27 bp, Homo sapiens
aatattaactcaaaagttgagattttg

SEQ ID NO: 1854 - DNA, 27 bp, Homo sapiens
ggtgtgccaagacattaattttttttt

SEQ ID NO: 1855 - DNA, 27 bp, Homo sapiens
gccaagacattaattttttttttaaac

SEQ ID NO: 1856 - DNA, 27 bp, Homo sapiens
ccaagacattaattttttttttaaaca

SEQ ID NO: 1857 - DNA, 27 bp, Homo sapiens
cattaattttttttttaaacaatgaag

SEQ ID NO: 1858 - DNA, 27 bp, Homo sapiens
attaattttttttttaaacaatgaagt

SEQ ID NO: 1859 - DNA, 27 bp, Homo sapiens
taattttttttttaaacaatgaagtga

SEQ ID NO: 1860 - DNA, 27 bp, Homo sapiens
attttttttttaaacaatgaagtgaaa

SEQ ID NO: 1861 - DNA, 27 bp, Homo sapiens
ttttttttttaaacaatgaagtgaaaa

SEQ ID NO: 1862 - DNA, 27 bp, Homo sapiens
tttttttttaaacaatgaagtgaaaaa

SEQ ID NO: 1863 - DNA, 27 bp, Homo sapiens
ttttttttaaacaatgaagtgaaaaag

SEQ ID NO: 1864 - DNA, 27 bp, Homo sapiens
tttttttaaacaatgaagtgaaaaagt

SEQ ID NO: 1865 - DNA, 27 bp, Homo sapiens
tttttaaacaatgaagtgaaaaagttt

SEQ ID NO: 1866 - DNA, 27 bp, Homo sapiens
ttttaaacaatgaagtgaaaaagtttt

SEQ ID NO: 1867 - DNA, 27 bp, Homo sapiens
tttaaacaatgaagtgaaaaagtttta

SEQ ID NO: 1868 - DNA, 27 bp, Homo sapiens
atgaagtgaaaaagttttacaatctct

SEQ ID NO: 1869 - DNA, 27 bp, Homo sapiens
tgaaaaagttttacaatctctaggttt

SEQ ID NO: 1870 - DNA, 27 bp, Homo sapiens
gaaaaagttttacaatctctaggtttg

SEQ ID NO: 1871 - DNA, 27 bp, Homo sapiens
aaaaagttttacaatctctaggtttgg

SEQ ID NO: 1872 - DNA, 27 bp, Homo sapiens
actggttaaattaacattgcataaaca

SEQ ID NO: 1873 - DNA, 27 bp, Homo sapiens
ctggttaaattaacattgcataaacac

SEQ ID NO: 1874 - DNA, 27 bp, Homo sapiens
tggttaaattaacattgcataaacact

SEQ ID NO: 1875 - DNA, 27 bp, Homo sapiens
acattgcataaacacttttcaagtctg

SEQ ID NO: 1876 - DNA, 27 bp, Homo sapiens
tcaagtctgatccatatttaataatgc

SEQ ID NO: 1877 - DNA, 27 bp, Homo sapiens
tccatatttaataatgctttaaaataa

SEQ ID NO: 1878 - DNA, 27 bp, Homo sapiens
ccatatttaataatgctttaaaataaa

SEQ ID NO: 1879 - DNA, 27 bp, Homo sapiens
catatttaataatgctttaaaataaaa

SEQ ID NO: 1880 - DNA, 27 bp, Homo sapiens
atatttaataatgctttaaaataaaaa

SEQ ID NO: 1881 - DNA, 27 bp, Homo sapiens
tatttaataatgctttaaaataaaaat

SEQ ID NO: 1882 - DNA, 27 bp, Homo sapiens
atttaataatgctttaaaataaaaata

SEQ ID NO: 1883 - DNA, 27 bp, Homo sapiens
ttaataatgctttaaaataaaaataaa

SEQ ID NO: 1884 - DNA, 27 bp, Homo sapiens
taataatgctttaaaataaaaataaaa

SEQ ID NO: 1885 - DNA, 27 bp, Homo sapiens
aataatgctttaaaataaaaataaaaa

SEQ ID NO: 1886 - DNA, 27 bp, Homo sapiens
ataatgctttaaaataaaaataaaaac

SEQ ID NO: 1887 - DNA, 27 bp, Homo sapiens
tttaaaataaaaataaaaacaatcctt

SEQ ID NO: 1888 - DNA, 27 bp, Homo sapiens
ataaaaataaaaacaatccttttgata

SEQ ID NO: 1889 - DNA, 27 bp, Homo sapiens
taaaaataaaaacaatccttttgataa

SEQ ID NO: 1890 - DNA, 27 bp, Homo sapiens
aaaaataaaaacaatccttttgataaa

SEQ ID NO: 1891 - DNA, 27 bp, Homo sapiens
aaaataaaaacaatccttttgataaat

SEQ ID NO: 1892 - DNA, 27 bp, Homo sapiens
aaataaaaacaatccttttgataaatt

SEQ ID NO: 1893 - DNA, 27 bp, Homo sapiens
aataaaaacaatccttttgataaattt

SEQ ID NO: 1894 - DNA, 27 bp, Homo sapiens
ataaaaacaatccttttgataaattta

SEQ ID NO: 1895 - DNA, 27 bp, Homo sapiens
taaaaacaatccttttgataaatttaa

SEQ ID NO: 1896 - DNA, 27 bp, Homo sapiens
aacaatccttttgataaatttaaaatg

SEQ ID NO: 1897 - DNA, 27 bp, Homo sapiens
tccttttgataaatttaaaatgttact

SEQ ID NO: 1898 - DNA, 27 bp, Homo sapiens
ccttttgataaatttaaaatgttactt

SEQ ID NO: 1899 - DNA, 27 bp, Homo sapiens
cttttgataaatttaaaatgttactta

SEQ ID NO: 1900 - DNA, 27 bp, Homo sapiens
tgataaatttaaaatgttacttatttt

SEQ ID NO: 1901 - DNA, 27 bp, Homo sapiens
gataaatttaaaatgttacttatttta

SEQ ID NO: 1902 - DNA, 27 bp, Homo sapiens
ataaatttaaaatgttacttattttaa

SEQ ID NO: 1903 - DNA, 27 bp, Homo sapiens
taaatttaaaatgttacttattttaaa

SEQ ID NO: 1904 - DNA, 27 bp, Homo sapiens
aaatttaaaatgttacttattttaaaa

SEQ ID NO: 1905 - DNA, 27 bp, Homo sapiens
aatttaaaatgttacttattttaaaat

SEQ ID NO: 1906 - DNA, 27 bp, Homo sapiens
tttaaaatgttacttattttaaaataa

SEQ ID NO: 1907 - DNA, 27 bp, Homo sapiens
ttaaaatgttacttattttaaaataaa

SEQ ID NO: 1908 - DNA, 27 bp, Homo sapiens
taaaatgttacttattttaaaataaat

SEQ ID NO: 1909 - DNA, 27 bp, Homo sapiens
aaaatgttacttattttaaaataaatg

SEQ ID NO: 1910 - DNA, 27 bp, Homo sapiens
aaatgttacttattttaaaataaatga

SEQ ID NO: 1911 - DNA, 27 bp, Homo sapiens
atgttacttattttaaaataaatgaag

SEQ ID NO: 1912 - DNA, 27 bp, Homo sapiens
acttattttaaaataaatgaagtgaga

SEQ ID NO: 1913 - DNA, 27 bp, Homo sapiens
ttattttaaaataaatgaagtgagatg

SEQ ID NO: 1914 - DNA, 27 bp, Homo sapiens
tattttaaaataaatgaagtgagatgg

SEQ ID NO: 1915 - DNA, 27 bp, Homo sapiens
tttaaaataaatgaagtgagatggcat

SEQ ID NO: 1916 - DNA, 27 bp, Homo sapiens
ttaaaataaatgaagtgagatggcatg

SEQ ID NO: 1917 - DNA, 27 bp, Homo sapiens
tccatttcttcatgttaaaagaagtca

SEQ ID NO: 1918 - DNA, 27 bp, Homo sapiens
ccatttcttcatgttaaaagaagtcat

SEQ ID NO: 1919 - DNA, 27 bp, Homo sapiens
ctcaaactcttagttttttttttttac

SEQ ID NO: 1920 - DNA, 27 bp, Homo sapiens
tagttttttttttttacaactatgtaa

SEQ ID NO: 1921 - DNA, 27 bp, Homo sapiens
agttttttttttttacaactatgtaat

SEQ ID NO: 1922 - DNA, 27 bp, Homo sapiens
gttttttttttttacaactatgtaatt

SEQ ID NO: 1923 - DNA, 27 bp, Homo sapiens
ttttttttttttacaactatgtaattt

SEQ ID NO: 1924 - DNA, 27 bp, Homo sapiens
tttttttttttacaactatgtaattta

SEQ ID NO: 1925 - DNA, 27 bp, Homo sapiens
ttttttttttacaactatgtaatttat

SEQ ID NO: 1926 - DNA, 27 bp, Homo sapiens
tttttttttacaactatgtaatttata

SEQ ID NO: 1927 - DNA, 27 bp, Homo sapiens
ttttttttacaactatgtaatttatat

SEQ ID NO: 1928 - DNA, 27 bp, Homo sapiens
tttttttacaactatgtaatttatatt

SEQ ID NO: 1929 - DNA, 27 bp, Homo sapiens
ttttttacaactatgtaatttatattc

SEQ ID NO: 1930 - DNA, 27 bp, Homo sapiens
tttttacaactatgtaatttatattcc

SEQ ID NO: 1931 - DNA, 27 bp, Homo sapiens
aactatgtaatttatattccatttaca

SEQ ID NO: 1932 - DNA, 27 bp, Homo sapiens
actatgtaatttatattccatttacat

SEQ ID NO: 1933 - DNA, 27 bp, Homo sapiens
ctatgtaatttatattccatttacata

SEQ ID NO: 1934 - DNA, 27 bp, Homo sapiens
aatttatattccatttacataaggata

SEQ ID NO: 1935 - DNA, 27 bp, Homo sapiens
atttatattccatttacataaggatac

SEQ ID NO: 1936 - DNA, 27 bp, Homo sapiens
tttatattccatttacataaggataca

SEQ ID NO: 1937 - DNA, 27 bp, Homo sapiens
ttatattccatttacataaggatacac

SEQ ID NO: 1938 - DNA, 27 bp, Homo sapiens
tacataaggatacacttatttgtcaag

SEQ ID NO: 1939 - DNA, 27 bp, Homo sapiens
taaggatacacttatttgtcaagctca

SEQ ID NO: 1940 - DNA, 27 bp, Homo sapiens
atctgtaaatttttaacctatgttaca

SEQ ID NO: 1941 - DNA, 27 bp, Homo sapiens
tctgtaaatttttaacctatgttacac

SEQ ID NO: 1942 - DNA, 27 bp, Homo sapiens
ctgtaaatttttaacctatgttacacc

SEQ ID NO: 1943 - DNA, 27 bp, Homo sapiens
tgcaagaggtgaagtttatatttgaat

SEQ ID NO: 1944 - DNA, 27 bp, Homo sapiens
caagaggtgaagtttatatttgaatat

SEQ ID NO: 1945 - DNA, 27 bp, Homo sapiens
aagaggtgaagtttatatttgaatatc

SEQ ID NO: 1946 - DNA, 27 bp, Homo sapiens
gaggtgaagtttatatttgaatatcca

SEQ ID NO: 1947 - DNA, 27 bp, Homo sapiens
aggtgaagtttatatttgaatatccat

SEQ ID NO: 1948 - DNA, 27 bp, Homo sapiens
aagtttatatttgaatatccattctcg

SEQ ID NO: 1949 - DNA, 27 bp, Homo sapiens
acttgatgcagttttaatacttgtaat

SEQ ID NO: 1950 - DNA, 27 bp, Homo sapiens
ttgatgcagttttaatacttgtaattc

SEQ ID NO: 1951 - DNA, 27 bp, Homo sapiens
gatttgacctaatcactaattttcagg

SEQ ID NO: 1952 - DNA, 27 bp, Homo sapiens
acctaatcactaattttcaggtggtgg

SEQ ID NO: 1953 - DNA, 27 bp, Homo sapiens
cagtaggatttttcaaacctggtatga

SEQ ID NO: 1954 - DNA, 27 bp, Homo sapiens
agtggaaggagaatttaataaagatag

SEQ ID NO: 1955 - DNA, 27 bp, Homo sapiens
ggaaggagaatttaataaagatagtgc

SEQ ID NO: 1956 - DNA, 27 bp, Homo sapiens
aaggagaatttaataaagatagtgctg

SEQ ID NO: 1957 - DNA, 27 bp, Homo sapiens
aggagaatttaataaagatagtgctga

SEQ ID NO: 1958 - DNA, 27 bp, Homo sapiens
gaatttaataaagatagtgctgaaaga

SEQ ID NO: 1959 - DNA, 27 bp, Homo sapiens
tccttaggtaatctataactaggacta

SEQ ID NO: 1960 - DNA, 27 bp, Homo sapiens
ccttaggtaatctataactaggactac

SEQ ID NO: 1961 - DNA, 27 bp, Homo sapiens
aacagtaatacattccattgttttagt

SEQ ID NO: 1962 - DNA, 27 bp, Homo sapiens
cagtaatacattccattgttttagtaa

SEQ ID NO: 1963 - DNA, 27 bp, Homo sapiens
agtaatacattccattgttttagtaac

SEQ ID NO: 1964 - DNA, 27 bp, Homo sapiens
gtaatacattccattgttttagtaacc

SEQ ID NO: 1965 - DNA, 27 bp, Homo sapiens
ccattgttttagtaaccagaaatcttc

SEQ ID NO: 1966 - DNA, 27 bp, Homo sapiens
accagaaatcttcatgcaatgaaaaat

SEQ ID NO: 1967 - DNA, 27 bp, Homo sapiens
ttcatgcaatgaaaaatactttaattc

SEQ ID NO: 1968 - DNA, 27 bp, Homo sapiens
aatgaaaaatactttaattcatgaagc

SEQ ID NO: 1969 - DNA, 27 bp, Homo sapiens
tgaaaaatactttaattcatgaagctt

SEQ ID NO: 1970 - DNA, 27 bp, Homo sapiens
gaaaaatactttaattcatgaagctta

SEQ ID NO: 1971 - DNA, 27 bp, Homo sapiens
ttcatgaagcttactttttttttttgg

SEQ ID NO: 1972 - DNA, 27 bp, Homo sapiens
atgaagcttactttttttttttggtgt

SEQ ID NO: 1973 - DNA, 27 bp, Homo sapiens
agcttactttttttttttggtgtcaga

SEQ ID NO: 1974 - DNA, 27 bp, Homo sapiens
tactttttttttttggtgtcagagtct

SEQ ID NO: 1975 - DNA, 27 bp, Homo sapiens
actttttttttttggtgtcagagtctc

SEQ ID NO: 1976 - DNA, 27 bp, Homo sapiens
aactaatttttgtatttttaggagaga

SEQ ID NO: 1977 - DNA, 27 bp, Homo sapiens
taatttttgtatttttaggagagacgg

SEQ ID NO: 1978 - DNA, 27 bp, Homo sapiens
ctcatttattcagcaaatatttattga

SEQ ID NO: 1979 - DNA, 27 bp, Homo sapiens
catttattcagcaaatatttattgagt

SEQ ID NO: 1980 - DNA, 27 bp, Homo sapiens
tttattcagcaaatatttattgagtgc

SEQ ID NO: 1981 - DNA, 27 bp, Homo sapiens
tattttagttttgcaaagaaggggttt

SEQ ID NO: 1982 - DNA, 27 bp, Homo sapiens
ctctataattgttttgctacgattcca

SEQ ID NO: 1983 - DNA, 27 bp, Homo sapiens
tactttatgtaaatcacttcattgttt

SEQ ID NO: 1984 - DNA, 27 bp, Homo sapiens
actttatgtaaatcacttcattgtttt

SEQ ID NO: 1985 - DNA, 27 bp, Homo sapiens
ctttatgtaaatcacttcattgtttta

SEQ ID NO: 1986 - DNA, 27 bp, Homo sapiens
tttatgtaaatcacttcattgttttaa

SEQ ID NO: 1987 - DNA, 27 bp, Homo sapiens
ttatgtaaatcacttcattgttttaaa

SEQ ID NO: 1988 - DNA, 27 bp, Homo sapiens
tatgtaaatcacttcattgttttaaag

SEQ ID NO: 1989 - DNA, 27 bp, Homo sapiens
atgtaaatcacttcattgttttaaagg

SEQ ID NO: 1990 - DNA, 27 bp, Homo sapiens
attgttttaaaggaataaacttgatta

SEQ ID NO: 1991 - DNA, 27 bp, Homo sapiens
ttgttttaaaggaataaacttgattat

SEQ ID NO: 1992 - DNA, 27 bp, Homo sapiens
ttttaaaggaataaacttgattatatt

SEQ ID NO: 1993 - DNA, 27 bp, Homo sapiens
tttaaaggaataaacttgattatattg

SEQ ID NO: 1994 - DNA, 27 bp, Homo sapiens
ttaaaggaataaacttgattatattgt

SEQ ID NO: 1995 - DNA, 27 bp, Homo sapiens
aaaggaataaacttgattatattgttt

SEQ ID NO: 1996 - DNA, 27 bp, Homo sapiens
aaggaataaacttgattatattgtttt

SEQ ID NO: 1997 - DNA, 27 bp, Homo sapiens
aggaataaacttgattatattgttttt

SEQ ID NO: 1998 - DNA, 27 bp, Homo sapiens
ggaataaacttgattatattgtttttt

SEQ ID NO: 1999 - DNA, 27 bp, Homo sapiens
gaataaacttgattatattgttttttt

SEQ ID NO: 2000 - DNA, 27 bp, Homo sapiens
aacttgattatattgtttttttatttg

SEQ ID NO: 2001 - DNA, 27 bp, Homo sapiens
acttgattatattgtttttttatttgg

SEQ ID NO: 2002 - DNA, 27 bp, Homo sapiens
tgattatattgtttttttatttggcat

SEQ ID NO: 2003 - DNA, 27 bp, Homo sapiens
atattgtttttttatttggcataactg

SEQ ID NO: 2004 - DNA, 27 bp, Homo sapiens
tattgtttttttatttggcataactgt

SEQ ID NO: 2005 - DNA, 27 bp, Homo sapiens
gtttttttatttggcataactgtgatt

SEQ ID NO: 2006 - DNA, 27 bp, Homo sapiens
tttttttatttggcataactgtgattc

SEQ ID NO: 2007 - DNA, 27 bp, Homo sapiens
gcataactgtgattcttttaggacaat

SEQ ID NO: 2008 - DNA, 27 bp, Homo sapiens
actgtgattcttttaggacaattactg

SEQ ID NO: 2009 - DNA, 27 bp, Homo sapiens
ctgtgattcttttaggacaattactgt

SEQ ID NO: 2010 - DNA, 27 bp, Homo sapiens
ggtgtatgtcagatattcatattgacc

SEQ ID NO: 2011 - DNA, 27 bp, Homo sapiens
gtgtatgtcagatattcatattgaccc

SEQ ID NO: 2012 - DNA, 27 bp, Homo sapiens
caaatgtgtaatattccagttttctct

SEQ ID NO: 2013 - DNA, 27 bp, Homo sapiens
cataagtaattaaaatatacttaaaaa

SEQ ID NO: 2014 - DNA, 27 bp, Homo sapiens
ataagtaattaaaatatacttaaaaat

SEQ ID NO: 2015 - DNA, 27 bp, Homo sapiens
taagtaattaaaatatacttaaaaatt

SEQ ID NO: 2016 - DNA, 27 bp, Homo sapiens
aagtaattaaaatatacttaaaaatta

SEQ ID NO: 2017 - DNA, 27 bp, Homo sapiens
agtaattaaaatatacttaaaaattaa

SEQ ID NO: 2018 - DNA, 27 bp, Homo sapiens
gtaattaaaatatacttaaaaattaat

SEQ ID NO: 2019 - DNA, 27 bp, Homo sapiens
taattaaaatatacttaaaaattaata

SEQ ID NO: 2020 - DNA, 27 bp, Homo sapiens
aattaaaatatacttaaaaattaatag

SEQ ID NO: 2021 - DNA, 27 bp, Homo sapiens
attaaaatatacttaaaaattaatagt

SEQ ID NO: 2022 - DNA, 27 bp, Homo sapiens
taaaatatacttaaaaattaatagttt

SEQ ID NO: 2023 - DNA, 27 bp, Homo sapiens
aaaatatacttaaaaattaatagtttt

SEQ ID NO: 2024 - DNA, 27 bp, Homo sapiens
aaatatacttaaaaattaatagtttta

SEQ ID NO: 2025 - DNA, 27 bp, Homo sapiens
aatatacttaaaaattaatagttttat

SEQ ID NO: 2026 - DNA, 27 bp, Homo sapiens
tacttaaaaattaatagttttatctgg

SEQ ID NO: 2027 - DNA, 27 bp, Homo sapiens
taaaaattaatagttttatctgggtac

SEQ ID NO: 2028 - DNA, 27 bp, Homo sapiens
aaaaattaatagttttatctgggtaca

SEQ ID NO: 2029 - DNA, 27 bp, Homo sapiens
aaaattaatagttttatctgggtacaa

SEQ ID NO: 2030 - DNA, 27 bp, Homo sapiens
atctgggtacaaataaacaggtgcctg

SEQ ID NO: 2031 - DNA, 27 bp, Homo sapiens
gacaaggaaacttctatgtaaaaatca

SEQ ID NO: 2032 - DNA, 27 bp, Homo sapiens
acaaggaaacttctatgtaaaaatcac

SEQ ID NO: 2033 - DNA, 27 bp, Homo sapiens
caaggaaacttctatgtaaaaatcact

SEQ ID NO: 2034 - DNA, 27 bp, Homo sapiens
ttctatgtaaaaatcactatgatttct

SEQ ID NO: 2035 - DNA, 27 bp, Homo sapiens
tctatgtaaaaatcactatgatttctg

SEQ ID NO: 2036 - DNA, 27 bp, Homo sapiens
ctatgtaaaaatcactatgatttctga

SEQ ID NO: 2037 - DNA, 27 bp, Homo sapiens
gtaaaaatcactatgatttctgaattg

SEQ ID NO: 2038 - DNA, 27 bp, Homo sapiens
taaaaatcactatgatttctgaattgc

SEQ ID NO: 2039 - DNA, 27 bp, Homo sapiens
ctatgatttctgaattgctatgtgaaa

SEQ ID NO: 2040 - DNA, 27 bp, Homo sapiens
tatgatttctgaattgctatgtgaaac

SEQ ID NO: 2041 - DNA, 27 bp, Homo sapiens
tatgtgaaactacagatctttggaaca

SEQ ID NO: 2042 - DNA, 27 bp, Homo sapiens
atgtgaaactacagatctttggaacac

SEQ ID NO: 2043 - DNA, 27 bp, Homo sapiens
agggtgttaagacttacacagtacctc

SEQ ID NO: 2044 - DNA, 27 bp, Homo sapiens
tttaggcctcttgaatttttgatgtag

SEQ ID NO: 2045 - DNA, 27 bp, Homo sapiens
tcttgaatttttgatgtagatgggcat

SEQ ID NO: 2046 - DNA, 27 bp, Homo sapiens
cttgaatttttgatgtagatgggcatt

SEQ ID NO: 2047 - DNA, 27 bp, Homo sapiens
tagatgggcatttttttaaggtagtgg

SEQ ID NO: 2048 - DNA, 27 bp, Homo sapiens
ggcatttttttaaggtagtggttaatt

SEQ ID NO: 2049 - DNA, 27 bp, Homo sapiens
aggtagtggttaattacctttatgtga

SEQ ID NO: 2050 - DNA, 27 bp, Homo sapiens
gtagtggttaattacctttatgtgaac

SEQ ID NO: 2051 - DNA, 27 bp, Homo sapiens
tagtggttaattacctttatgtgaact

SEQ ID NO: 2052 - DNA, 27 bp, Homo sapiens
agtggttaattacctttatgtgaactt

SEQ ID NO: 2053 - DNA, 27 bp, Homo sapiens
gtggttaattacctttatgtgaacttt

SEQ ID NO: 2054 - DNA, 27 bp, Homo sapiens
acctttatgtgaactttgaatggttta

SEQ ID NO: 2055 - DNA, 27 bp, Homo sapiens
tatgtgaactttgaatggtttaacaaa

SEQ ID NO: 2056 - DNA, 27 bp, Homo sapiens
aactttgaatggtttaacaaaagattt

SEQ ID NO: 2057 - DNA, 27 bp, Homo sapiens
ttgaatggtttaacaaaagatttgttt

SEQ ID NO: 2058 - DNA, 27 bp, Homo sapiens
tgaatggtttaacaaaagatttgtttt

SEQ ID NO: 2059 - DNA, 27 bp, Homo sapiens
gaatggtttaacaaaagatttgttttt

SEQ ID NO: 2060 - DNA, 27 bp, Homo sapiens
aatggtttaacaaaagatttgtttttg

SEQ ID NO: 2061 - DNA, 27 bp, Homo sapiens
atggtttaacaaaagatttgtttttgt

SEQ ID NO: 2062 - DNA, 27 bp, Homo sapiens
ggtttaacaaaagatttgtttttgtag

SEQ ID NO: 2063 - DNA, 27 bp, Homo sapiens
gtttaacaaaagatttgtttttgtaga

SEQ ID NO: 2064 - DNA, 27 bp, Homo sapiens
aacaaaagatttgtttttgtagagatt

SEQ ID NO: 2065 - DNA, 27 bp, Homo sapiens
acaaaagatttgtttttgtagagattt

SEQ ID NO: 2066 - DNA, 27 bp, Homo sapiens
caaaagatttgtttttgtagagatttt

SEQ ID NO: 2067 - DNA, 27 bp, Homo sapiens
aaagatttgtttttgtagagattttaa

SEQ ID NO: 2068 - DNA, 27 bp, Homo sapiens
aagatttgtttttgtagagattttaaa

SEQ ID NO: 2069 - DNA, 27 bp, Homo sapiens
agatttgtttttgtagagattttaaag

SEQ ID NO: 2070 - DNA, 27 bp, Homo sapiens
gatttgtttttgtagagattttaaagg

SEQ ID NO: 2071 - DNA, 27 bp, Homo sapiens
tttttgtagagattttaaagggggaga

SEQ ID NO: 2072 - DNA, 27 bp, Homo sapiens
aagggggagaattctagaaataaatgt

SEQ ID NO: 2073 - DNA, 27 bp, Homo sapiens
gggggagaattctagaaataaatgtta

SEQ ID NO: 2074 - DNA, 27 bp, Homo sapiens
ggggagaattctagaaataaatgttac

SEQ ID NO: 2075 - DNA, 27 bp, Homo sapiens
gggagaattctagaaataaatgttacc

SEQ ID NO: 2076 - DNA, 27 bp, Homo sapiens
ggagaattctagaaataaatgttacct

SEQ ID NO: 2077 - DNA, 27 bp, Homo sapiens
gagaattctagaaataaatgttaccta

SEQ ID NO: 2078 - DNA, 27 bp, Homo sapiens
ttctagaaataaatgttacctaattat

SEQ ID NO: 2079 - DNA, 27 bp, Homo sapiens
tctagaaataaatgttacctaattatt

SEQ ID NO: 2080 - DNA, 27 bp, Homo sapiens
ctagaaataaatgttacctaattatta

SEQ ID NO: 2081 - DNA, 27 bp, Homo sapiens
tagaaataaatgttacctaattattac

SEQ ID NO: 2082 - DNA, 27 bp, Homo sapiens
agaaataaatgttacctaattattaca

SEQ ID NO: 2083 - DNA, 27 bp, Homo sapiens
aaataaatgttacctaattattacagc

SEQ ID NO: 2084 - DNA, 27 bp, Homo sapiens
acctaattattacagccttaaagacaa

SEQ ID NO: 2085 - DNA, 27 bp, Homo sapiens
cctaattattacagccttaaagacaaa

SEQ ID NO: 2086 - DNA, 27 bp, Homo sapiens
ccttaaagacaaaaatccttgttgaag

SEQ ID NO: 2087 - DNA, 27 bp, Homo sapiens
taaagacaaaaatccttgttgaagttt

SEQ ID NO: 2088 - DNA, 27 bp, Homo sapiens
tccttgttgaagtttttttaaaaaaag

SEQ ID NO: 2089 - DNA, 27 bp, Homo sapiens
ccttgttgaagtttttttaaaaaaagc

SEQ ID NO: 2090 - DNA, 27 bp, Homo sapiens
ttgttgaagtttttttaaaaaaagcta

SEQ ID NO: 2091 - DNA, 27 bp, Homo sapiens
tgttgaagtttttttaaaaaaagctaa

SEQ ID NO: 2092 - DNA, 27 bp, Homo sapiens
gaagtttttttaaaaaaagctaaatta

SEQ ID NO: 2093 - DNA, 27 bp, Homo sapiens
aagtttttttaaaaaaagctaaattac

SEQ ID NO: 2094 - DNA, 27 bp, Homo sapiens
agtttttttaaaaaaagctaaattaca

SEQ ID NO: 2095 - DNA, 27 bp, Homo sapiens
gtttttttaaaaaaagctaaattacat

SEQ ID NO: 2096 - DNA, 27 bp, Homo sapiens
tttttttaaaaaaagctaaattacata

SEQ ID NO: 2097 - DNA, 27 bp, Homo sapiens
tttaaaaaaagctaaattacatagact

SEQ ID NO: 2098 - DNA, 27 bp, Homo sapiens
taaaaaaagctaaattacatagactta

SEQ ID NO: 2099 - DNA, 27 bp, Homo sapiens
acttaggcattaacatgtttgtggaag

SEQ ID NO: 2100 - DNA, 27 bp, Homo sapiens
cttaggcattaacatgtttgtggaaga

SEQ ID NO: 2101 - DNA, 27 bp, Homo sapiens
agcagacgtatattgtatcatttgagt

SEQ ID NO: 2102 - DNA, 27 bp, Homo sapiens
gacgtatattgtatcatttgagtgaat

SEQ ID NO: 2103 - DNA, 27 bp, Homo sapiens
cgtatattgtatcatttgagtgaatgt

SEQ ID NO: 2104 - DNA, 27 bp, Homo sapiens
atattgtatcatttgagtgaatgttcc

SEQ ID NO: 2105 - DNA, 27 bp, Homo sapiens
tattgtatcatttgagtgaatgttccc

SEQ ID NO: 2106 - DNA, 27 bp, Homo sapiens
attgtatcatttgagtgaatgttccca

SEQ ID NO: 2107 - DNA, 27 bp, Homo sapiens
ataggaatttagaacctaacttttata

SEQ ID NO: 2108 - DNA, 27 bp, Homo sapiens
taggaatttagaacctaacttttatag

SEQ ID NO: 2109 - DNA, 27 bp, Homo sapiens
aatttagaacctaacttttataggtta

SEQ ID NO: 2110 - DNA, 27 bp, Homo sapiens
atttagaacctaacttttataggttat

SEQ ID NO: 2111 - DNA, 27 bp, Homo sapiens
tttagaacctaacttttataggttatc

SEQ ID NO: 2112 - DNA, 27 bp, Homo sapiens
ttagaacctaacttttataggttatca

SEQ ID NO: 2113 - DNA, 27 bp, Homo sapiens
ttttataggttatcaaaactgttgtca

SEQ ID NO: 2114 - DNA, 27 bp, Homo sapiens
ttataggttatcaaaactgttgtcacc

SEQ ID NO: 2115 - DNA, 27 bp, Homo sapiens
aattttgtcctaatatatacatagaaa

SEQ ID NO: 2116 - DNA, 27 bp, Homo sapiens
attttgtcctaatatatacatagaaac

SEQ ID NO: 2117 - DNA, 27 bp, Homo sapiens
ttttgtcctaatatatacatagaaact

SEQ ID NO: 2118 - DNA, 27 bp, Homo sapiens
cctaatatatacatagaaactttgtgg

SEQ ID NO: 2119 - DNA, 27 bp, Homo sapiens
tatatacatagaaactttgtggggcat

SEQ ID NO: 2120 - DNA, 27 bp, Homo sapiens
cacaagttcatctcatttgtattccat

SEQ ID NO: 2121 - DNA, 27 bp, Homo sapiens
ctcatttgtattccattgatttttttt

SEQ ID NO: 2122 - DNA, 27 bp, Homo sapiens
tcatttgtattccattgattttttttt

SEQ ID NO: 2123 - DNA, 27 bp, Homo sapiens
catttgtattccattgatttttttttt

SEQ ID NO: 2124 - DNA, 27 bp, Homo sapiens
atttgtattccattgattttttttttc

SEQ ID NO: 2125 - DNA, 27 bp, Homo sapiens
tttgtattccattgattttttttttct

SEQ ID NO: 2126 - DNA, 27 bp, Homo sapiens
ttgtattccattgattttttttttctt

SEQ ID NO: 2127 - DNA, 27 bp, Homo sapiens
tgtattccattgattttttttttcttc

SEQ ID NO: 2128 - DNA, 27 bp, Homo sapiens
cattgattttttttttcttctaaacat

SEQ ID NO: 2129 - DNA, 27 bp, Homo sapiens
attgattttttttttcttctaaacatt

SEQ ID NO: 2130 - DNA, 27 bp, Homo sapiens
attttttttttcttctaaacatttttt

SEQ ID NO: 2131 - DNA, 27 bp, Homo sapiens
ttttttttttcttctaaacattttttc

SEQ ID NO: 2132 - DNA, 27 bp, Homo sapiens
tttttttttcttctaaacattttttct

SEQ ID NO: 2133 - DNA, 27 bp, Homo sapiens
ttttttttcttctaaacattttttctt

SEQ ID NO: 2134 - DNA, 27 bp, Homo sapiens
tttttttcttctaaacattttttcttc

SEQ ID NO: 2135 - DNA, 27 bp, Homo sapiens
aacattttttcttcaaacagtatataa

SEQ ID NO: 2136 - DNA, 27 bp, Homo sapiens
acattttttcttcaaacagtatataac

SEQ ID NO: 2137 - DNA, 27 bp, Homo sapiens
cattttttcttcaaacagtatataact

SEQ ID NO: 2138 - DNA, 27 bp, Homo sapiens
attttttcttcaaacagtatataactt

SEQ ID NO: 2139 - DNA, 27 bp, Homo sapiens
ttttttcttcaaacagtatataacttt

SEQ ID NO: 2140 - DNA, 27 bp, Homo sapiens
ttcaaacagtatataactttttttagg

SEQ ID NO: 2141 - DNA, 27 bp, Homo sapiens
acagtatataactttttttaggggatt

SEQ ID NO: 2142 - DNA, 27 bp, Homo sapiens
cagtatataactttttttaggggattt

SEQ ID NO: 2143 - DNA, 27 bp, Homo sapiens
agtatataactttttttaggggatttt

SEQ ID NO: 2144 - DNA, 27 bp, Homo sapiens
gtatataactttttttaggggattttt

SEQ ID NO: 2145 - DNA, 27 bp, Homo sapiens
aactttttttaggggatttttttttag

SEQ ID NO: 2146 - DNA, 27 bp, Homo sapiens
actttttttaggggatttttttttaga

SEQ ID NO: 2147 - DNA, 27 bp, Homo sapiens
gggatttttttttagacagcaaaaact

SEQ ID NO: 2148 - DNA, 27 bp, Homo sapiens
ggatttttttttagacagcaaaaacta

SEQ ID NO: 2149 - DNA, 27 bp, Homo sapiens
gatttttttttagacagcaaaaactat

SEQ ID NO: 2150 - DNA, 27 bp, Homo sapiens
tgaagatttccatttgtcaaaaagtaa

SEQ ID NO: 2151 - DNA, 27 bp, Homo sapiens
gaagatttccatttgtcaaaaagtaat

SEQ ID NO: 2152 - DNA, 27 bp, Homo sapiens
aagatttccatttgtcaaaaagtaatg

SEQ ID NO: 2153 - DNA, 27 bp, Homo sapiens
agatttccatttgtcaaaaagtaatga

SEQ ID NO: 2154 - DNA, 27 bp, Homo sapiens
tccatttgtcaaaaagtaatgatttct

SEQ ID NO: 2155 - DNA, 27 bp, Homo sapiens
ccatttgtcaaaaagtaatgatttctt

SEQ ID NO: 2156 - DNA, 27 bp, Homo sapiens
catttgtcaaaaagtaatgatttcttg

SEQ ID NO: 2157 - DNA, 27 bp, Homo sapiens
gtcaaaaagtaatgatttcttgataat

SEQ ID NO: 2158 - DNA, 27 bp, Homo sapiens
tcaaaaagtaatgatttcttgataatt

SEQ ID NO: 2159 - DNA, 27 bp, Homo sapiens
caaaaagtaatgatttcttgataattg

SEQ ID NO: 2160 - DNA, 27 bp, Homo sapiens
aaaaagtaatgatttcttgataattgt

SEQ ID NO: 2161 - DNA, 27 bp, Homo sapiens
aaagtaatgatttcttgataattgtgt

SEQ ID NO: 2162 - DNA, 27 bp, Homo sapiens
agtaatgatttcttgataattgtgtag

SEQ ID NO: 2163 - DNA, 27 bp, Homo sapiens
gtaatgatttcttgataattgtgtagt

SEQ ID NO: 2164 - DNA, 27 bp, Homo sapiens
aatgatttcttgataattgtgtagtaa

SEQ ID NO: 2165 - DNA, 27 bp, Homo sapiens
atgatttcttgataattgtgtagtaat

SEQ ID NO: 2166 - DNA, 27 bp, Homo sapiens
ttcttgataattgtgtagtaatgtttt

SEQ ID NO: 2167 - DNA, 27 bp, Homo sapiens
tcttgataattgtgtagtaatgttttt

SEQ ID NO: 2168 - DNA, 27 bp, Homo sapiens
cttgataattgtgtagtaatgtttttt

SEQ ID NO: 2169 - DNA, 27 bp, Homo sapiens
tgataattgtgtagtaatgttttttag

SEQ ID NO: 2170 - DNA, 27 bp, Homo sapiens
taattgtgtagtaatgttttttagaac

SEQ ID NO: 2171 - DNA, 27 bp, Homo sapiens
attgtgtagtaatgttttttagaaccc

SEQ ID NO: 2172 - DNA, 27 bp, Homo sapiens
ttgtgtagtaatgttttttagaaccca

SEQ ID NO: 2173 - DNA, 27 bp, Homo sapiens
ccttaaagctgaatttatatttagtaa

SEQ ID NO: 2174 - DNA, 27 bp, Homo sapiens
ttaaagctgaatttatatttagtaact

SEQ ID NO: 2175 - DNA, 27 bp, Homo sapiens
aatttatatttagtaacttctgtgtta

SEQ ID NO: 2176 - DNA, 27 bp, Homo sapiens
atttatatttagtaacttctgtgttaa

SEQ ID NO: 2177 - DNA, 27 bp, Homo sapiens
tttatatttagtaacttctgtgttaat

SEQ ID NO: 2178 - DNA, 27 bp, Homo sapiens
atttagtaacttctgtgttaatactgg

SEQ ID NO: 2179 - DNA, 27 bp, Homo sapiens
actgaatagctgtcataaaatgaaact

SEQ ID NO: 2180 - DNA, 27 bp, Homo sapiens
ctgaatagctgtcataaaatgaaactt

SEQ ID NO: 2181 - DNA, 27 bp, Homo sapiens
taaaatgaaactttctttctaaagaaa

SEQ ID NO: 2182 - DNA, 27 bp, Homo sapiens
aaaatgaaactttctttctaaagaaag

SEQ ID NO: 2183 - DNA, 27 bp, Homo sapiens
aaatgaaactttctttctaaagaaaga

SEQ ID NO: 2184 - DNA, 27 bp, Homo sapiens
atgaaactttctttctaaagaaagata

SEQ ID NO: 2185 - DNA, 27 bp, Homo sapiens
aactttctttctaaagaaagatactca

SEQ ID NO: 2186 - DNA, 27 bp, Homo sapiens
cacatgagttcttgaagaatagtcata

SEQ ID NO: 2187 - DNA, 27 bp, Homo sapiens
tcttgaagaatagtcataactagatta

SEQ ID NO: 2188 - DNA, 27 bp, Homo sapiens
cttgaagaatagtcataactagattaa

SEQ ID NO: 2189 - DNA, 27 bp, Homo sapiens
ttgaagaatagtcataactagattaag

SEQ ID NO: 2190 - DNA, 27 bp, Homo sapiens
aagaatagtcataactagattaagatc

SEQ ID NO: 2191 - DNA, 27 bp, Homo sapiens
agaatagtcataactagattaagatct

SEQ ID NO: 2192 - DNA, 27 bp, Homo sapiens
gaatagtcataactagattaagatctg

SEQ ID NO: 2193 - DNA, 27 bp, Homo sapiens
aatagtcataactagattaagatctgt

SEQ ID NO: 2194 - DNA, 27 bp, Homo sapiens
gtcataactagattaagatctgtgttt

SEQ ID NO: 2195 - DNA, 27 bp, Homo sapiens
actagattaagatctgtgttttagttt

SEQ ID NO: 2196 - DNA, 27 bp, Homo sapiens
tagattaagatctgtgttttagtttaa

SEQ ID NO: 2197 - DNA, 27 bp, Homo sapiens
agattaagatctgtgttttagtttaat

SEQ ID NO: 2198 - DNA, 27 bp, Homo sapiens
attaagatctgtgttttagtttaatag

SEQ ID NO: 2199 - DNA, 27 bp, Homo sapiens
tctgtgttttagtttaatagtttgaag

SEQ ID NO: 2200 - DNA, 27 bp, Homo sapiens
ctgtgttttagtttaatagtttgaagt

SEQ ID NO: 2201 - DNA, 27 bp, Homo sapiens
gtgttttagtttaatagtttgaagtgc

SEQ ID NO: 2202 - DNA, 27 bp, Homo sapiens
gttttagtttaatagtttgaagtgcct

SEQ ID NO: 2203 - DNA, 27 bp, Homo sapiens
ttttagtttaatagtttgaagtgcctg

SEQ ID NO: 2204 - DNA, 27 bp, Homo sapiens
gtttgggataatgataggtaatttaga

SEQ ID NO: 2205 - DNA, 27 bp, Homo sapiens
ttgggataatgataggtaatttagatg

SEQ ID NO: 2206 - DNA, 27 bp, Homo sapiens
ggataatgataggtaatttagatgaat

SEQ ID NO: 2207 - DNA, 27 bp, Homo sapiens
gataatgataggtaatttagatgaatt

SEQ ID NO: 2208 - DNA, 27 bp, Homo sapiens
aatgataggtaatttagatgaatttag

SEQ ID NO: 2209 - DNA, 27 bp, Homo sapiens
atgataggtaatttagatgaatttagg

SEQ ID NO: 2210 - DNA, 27 bp, Homo sapiens
aggtaatttagatgaatttaggggaaa

SEQ ID NO: 2211 - DNA, 27 bp, Homo sapiens
gtaatttagatgaatttaggggaaaaa

SEQ ID NO: 2212 - DNA, 27 bp, Homo sapiens
agatgaatttaggggaaaaaaaagtta

SEQ ID NO: 2213 - DNA, 27 bp, Homo sapiens
gatgaatttaggggaaaaaaaagttat

SEQ ID NO: 2214 - DNA, 27 bp, Homo sapiens
gggaaaaaaaagttatctgcagatatg

SEQ ID NO: 2215 - DNA, 27 bp, Homo sapiens
ggaaaaaaaagttatctgcagatatgt

SEQ ID NO: 2216 - DNA, 27 bp, Homo sapiens
aaaaagttatctgcagatatgttgagg

SEQ ID NO: 2217 - DNA, 27 bp, Homo sapiens
gtcttgtgttttcatgttgaaaatact

SEQ ID NO: 2218 - DNA, 27 bp, Homo sapiens
tcttgtgttttcatgttgaaaatactt

SEQ ID NO: 2219 - DNA, 27 bp, Homo sapiens
cttgtgttttcatgttgaaaatacttt

SEQ ID NO: 2220 - DNA, 27 bp, Homo sapiens
catgttgaaaatacttttgcatttttc

SEQ ID NO: 2221 - DNA, 27 bp, Homo sapiens
atgttgaaaatacttttgcatttttcc

SEQ ID NO: 2222 - DNA, 27 bp, Homo sapiens
tgttgaaaatacttttgcatttttcct

SEQ ID NO: 2223 - DNA, 27 bp, Homo sapiens
gttgaaaatacttttgcatttttcctt

SEQ ID NO: 2224 - DNA, 27 bp, Homo sapiens
cttttgcatttttcctttgagtgccaa

SEQ ID NO: 2225 - DNA, 27 bp, Homo sapiens
tgagtgccaatttcttactagtactat

SEQ ID NO: 2226 - DNA, 27 bp, Homo sapiens
gccaatttcttactagtactatttctt

SEQ ID NO: 2227 - DNA, 27 bp, Homo sapiens
ccaatttcttactagtactatttctta

SEQ ID NO: 2228 - DNA, 27 bp, Homo sapiens
tactagtactatttcttaatgtaacat

SEQ ID NO: 2229 - DNA, 27 bp, Homo sapiens
actagtactatttcttaatgtaacatg

SEQ ID NO: 2230 - DNA, 27 bp, Homo sapiens
tactatttcttaatgtaacatgtttac

SEQ ID NO: 2231 - DNA, 27 bp, Homo sapiens
actatttcttaatgtaacatgtttacc

SEQ ID NO: 2232 - DNA, 27 bp, Homo sapiens
ctatttcttaatgtaacatgtttacct

SEQ ID NO: 2233 - DNA, 27 bp, Homo sapiens
ttaatgtaacatgtttacctggaatgt

SEQ ID NO: 2234 - DNA, 27 bp, Homo sapiens
cctggaatgtattttaactatttttgt

SEQ ID NO: 2235 - DNA, 27 bp, Homo sapiens
tggaatgtattttaactatttttgtat

SEQ ID NO: 2236 - DNA, 27 bp, Homo sapiens
ggaatgtattttaactatttttgtata

SEQ ID NO: 2237 - DNA, 27 bp, Homo sapiens
gaatgtattttaactatttttgtatag

SEQ ID NO: 2238 - DNA, 27 bp, Homo sapiens
aatgtattttaactatttttgtatagt

SEQ ID NO: 2239 - DNA, 27 bp, Homo sapiens
tgtattttaactatttttgtatagtgt

SEQ ID NO: 2240 - DNA, 27 bp, Homo sapiens
tattttaactatttttgtatagtgtaa

SEQ ID NO: 2241 - DNA, 27 bp, Homo sapiens
attttaactatttttgtatagtgtaaa

SEQ ID NO: 2242 - DNA, 27 bp, Homo sapiens
ttttaactatttttgtatagtgtaaac

SEQ ID NO: 2243 - DNA, 27 bp, Homo sapiens
tatttttgtatagtgtaaactgaaaca

SEQ ID NO: 2244 - DNA, 27 bp, Homo sapiens
atttttgtatagtgtaaactgaaacat

SEQ ID NO: 2245 - DNA, 27 bp, Homo sapiens
tttttgtatagtgtaaactgaaacatg

SEQ ID NO: 2246 - DNA, 27 bp, Homo sapiens
aactgaaacatgcacattttgtacatt

SEQ ID NO: 2247 - DNA, 27 bp, Homo sapiens
aacatgcacattttgtacattgtgctt

SEQ ID NO: 2248 - DNA, 27 bp, Homo sapiens
tccagttgttttccatcatttggttgc

SEQ ID NO: 2249 - DNA, 27 bp, Homo sapiens
cagttgttttccatcatttggttgcgc

SEQ ID NO: 2250 - DNA, 27 bp, Homo sapiens
atgttggtcatatcaaacattaaaaat

SEQ ID NO: 2251 - DNA, 27 bp, Homo sapiens
tgttggtcatatcaaacattaaaaatg

SEQ ID NO: 2252 - DNA, 27 bp, Homo sapiens
gttggtcatatcaaacattaaaaatga

SEQ ID NO: 2253 - DNA, 27 bp, Homo sapiens
gtcatatcaaacattaaaaatgaccac

SEQ ID NO: 2254 - DNA, 27 bp, Homo sapiens
aaaatgaccactcttttaattgaaatt

SEQ ID NO: 2255 - DNA, 27 bp, Homo sapiens
aaatgaccactcttttaattgaaatta

SEQ ID NO: 2256 - DNA, 27 bp, Homo sapiens
ctcttttaattgaaattaacttttaaa

SEQ ID NO: 2257 - DNA, 27 bp, Homo sapiens
tcttttaattgaaattaacttttaaat

SEQ ID NO: 2258 - DNA, 27 bp, Homo sapiens
ttttaattgaaattaacttttaaatgt

SEQ ID NO: 2259 - DNA, 27 bp, Homo sapiens
ttaattgaaattaacttttaaatgttt

SEQ ID NO: 2260 - DNA, 27 bp, Homo sapiens
taattgaaattaacttttaaatgttta

SEQ ID NO: 2261 - DNA, 27 bp, Homo sapiens
aattgaaattaacttttaaatgtttat

SEQ ID NO: 2262 - DNA, 27 bp, Homo sapiens
attgaaattaacttttaaatgtttata

SEQ ID NO: 2263 - DNA, 27 bp, Homo sapiens
ttgaaattaacttttaaatgtttatag

SEQ ID NO: 2264 - DNA, 27 bp, Homo sapiens
tgaaattaacttttaaatgtttatagg

SEQ ID NO: 2265 - DNA, 27 bp, Homo sapiens
aattaacttttaaatgtttataggagt

SEQ ID NO: 2266 - DNA, 27 bp, Homo sapiens
aacttttaaatgtttataggagtatgt

SEQ ID NO: 2267 - DNA, 27 bp, Homo sapiens
tttaaatgtttataggagtatgtgctg

SEQ ID NO: 2268 - DNA, 27 bp, Homo sapiens
ttaaatgtttataggagtatgtgctgt

SEQ ID NO: 2269 - DNA, 27 bp, Homo sapiens
gctgtgaagtgatctaaaatttgtaat

SEQ ID NO: 2270 - DNA, 27 bp, Homo sapiens
tgtgaagtgatctaaaatttgtaatat

SEQ ID NO: 2271 - DNA, 27 bp, Homo sapiens
gtgaagtgatctaaaatttgtaatatt

SEQ ID NO: 2272 - DNA, 27 bp, Homo sapiens
tgaagtgatctaaaatttgtaatattt

SEQ ID NO: 2273 - DNA, 27 bp, Homo sapiens
gaagtgatctaaaatttgtaatatttt

SEQ ID NO: 2274 - DNA, 27 bp, Homo sapiens
aagtgatctaaaatttgtaatattttt

SEQ ID NO: 2275 - DNA, 27 bp, Homo sapiens
agtgatctaaaatttgtaatatttttg

SEQ ID NO: 2276 - DNA, 27 bp, Homo sapiens
atctaaaatttgtaatatttttgtcat

SEQ ID NO: 2277 - DNA, 27 bp, Homo sapiens
tctaaaatttgtaatatttttgtcatg

SEQ ID NO: 2278 - DNA, 27 bp, Homo sapiens
aaatttgtaatatttttgtcatgaact

SEQ ID NO: 2279 - DNA, 27 bp, Homo sapiens
aatttgtaatatttttgtcatgaactg

SEQ ID NO: 2280 - DNA, 27 bp, Homo sapiens
atttgtaatatttttgtcatgaactgt

SEQ ID NO: 2281 - DNA, 27 bp, Homo sapiens
gtaatatttttgtcatgaactgtacta

SEQ ID NO: 2282 - DNA, 27 bp, Homo sapiens
taatatttttgtcatgaactgtactac

SEQ ID NO: 2283 - DNA, 27 bp, Homo sapiens
aactgtactactcctaattattgtaat

SEQ ID NO: 2284 - DNA, 27 bp, Homo sapiens
actgtactactcctaattattgtaatg

SEQ ID NO: 2285 - DNA, 27 bp, Homo sapiens
tcctaattattgtaatgtaataaaaat

SEQ ID NO: 2286 - DNA, 27 bp, Homo sapiens
cctaattattgtaatgtaataaaaata

SEQ ID NO: 2287 - DNA, 27 bp, Homo sapiens
taattattgtaatgtaataaaaatagt

SEQ ID NO: 2288 - DNA, 27 bp, Homo sapiens
attattgtaatgtaataaaaatagtta

SEQ ID NO: 2289 - DNA, 27 bp, Homo sapiens
ttattgtaatgtaataaaaatagttac

SEQ ID NO: 2290 - DNA, 27 bp, Homo sapiens
attgtaatgtaataaaaatagttacag

SEQ ID NO: 2291 - DNA, 27 bp, Homo sapiens
ttgtaatgtaataaaaatagttacagt

SEQ ID NO: 2292 - DNA, 27 bp, Homo sapiens
aatgtaataaaaatagttacagtgaca

SEQ ID NO: 2293 - DNA, 27 bp, Homo sapiens
atgtaataaaaatagttacagtgacaa

SEQ ID NO: 2294 - DNA, 27 bp, Homo sapiens
tgtaataaaaatagttacagtgacaaa

SEQ ID NO: 2295 - DNA, 27 bp, Homo sapiens
aaatagttacagtgacaaaaaaaaaaa

SEQ ID NO: 2296 - DNA, 27 bp, Homo sapiens
aatagttacagtgacaaaaaaaaaaaa

SEQ ID NO: 2297 - DNA, 27 bp, Homo sapiens
tagttacagtgacaaaaaaaaaaaaaa

SEQ ID NO: 2298 - RNA, 27 nt, Artificial Sequence
  Description of Artificial Sequence: Synthetic oligonucleotide
aguuuauauucagucauuuucagcagg

SEQ ID NO: 2299 - RNA, 27 nt, Artificial Sequence
  Description of Artificial Sequence: Synthetic oligonucleotide
accacaaguuuauauucagucauuuuc

SEQ ID NO: 2300 - RNA, 27 nt, Artificial Sequence
  Description of Artificial Sequence: Synthetic oligonucleotide
aacuaccacaaguuuauauucagucau

SEQ ID NO: 2301 - RNA, 27 nt, Artificial Sequence
  Description of Artificial Sequence: Synthetic oligonucleotide
uccacaaaaugauucugaauuagcugu

SEQ ID NO: 2302 - RNA, 27 nt, Artificial Sequence
  Description of Artificial Sequence: Synthetic oligonucleotide
uccucuauuguuggaucauauucgucc

SEQ ID NO: 2303 - RNA, 27 nt, Artificial Sequence
  Description of Artificial Sequence: Synthetic oligonucleotide
guuucuccaucaauuacuacuugcuuc

SEQ ID NO: 2304 - RNA, 27 nt, Artificial Sequence
  Description of Artificial Sequence: Synthetic oligonucleotide
ggcaaauacacaaagaaagcccucccc

SEQ ID NO: 2305 - RNA, 27 nt, Artificial Sequence
  Description of Artificial Sequence: Synthetic oligonucleotide
auuauuuauggcaaauacacaaagaaa

SEQ ID NO: 2306 - RNA, 27 nt, Artificial Sequence
  Description of Artificial Sequence: Synthetic oligonucleotide
uauuauuuauggcaaauacacaaagaa

SEQ ID NO: 2307 - RNA, 27 nt, Artificial Sequence
  Description of Artificial Sequence: Synthetic oligonucleotide
guauuauuuauggcaaauacacaaaga

SEQ ID NO: 2308 - RNA, 27 nt, Artificial Sequence
  Description of Artificial Sequence: Synthetic oligonucleotide
aguauuauuuauggcaaauacacaaag

SEQ ID NO: 2309 - RNA, 27 nt, Artificial Sequence
  Description of Artificial Sequence: Synthetic oligonucleotide
auuuaguauuauuuauggcaaauacac

SEQ ID NO: 2310 - RNA, 27 nt, Artificial Sequence
  Description of Artificial Sequence: Synthetic oligonucleotide
gauuuaguauuauuuauggcaaauaca

SEQ ID NO: 2311 - RNA, 27 nt, Artificial Sequence
  Description of Artificial Sequence: Synthetic oligonucleotide
ucaaaugauuuaguauuauuuauggca

SEQ ID NO: 2312 - RNA, 27 nt, Artificial Sequence
  Description of Artificial Sequence: Synthetic oligonucleotide
uucaaaugauuuaguauuauuuauggc

SEQ ID NO: 2313 - RNA, 27 nt, Artificial Sequence
  Description of Artificial Sequence: Synthetic oligonucleotide
ucuucaaaugauuuaguauuauuuaug

SEQ ID NO: 2314 - RNA, 27 nt, Artificial Sequence
  Description of Artificial Sequence: Synthetic oligonucleotide
aucuucaaaugauuuaguauuauuuau

SEQ ID NO: 2315 - RNA, 27 nt, Artificial Sequence
  Description of Artificial Sequence: Synthetic oligonucleotide
uaucuucaaaugauuuaguauuauuua

SEQ ID NO: 2316 - RNA, 27 nt, Artificial Sequence
  Description of Artificial Sequence: Synthetic oligonucleotide
auaucuucaaaugauuuaguauuauuu

SEQ ID NO: 2317 - RNA, 27 nt, Artificial Sequence
  Description of Artificial Sequence: Synthetic oligonucleotide
ucuauaauggugaauaucuucaaauga

SEQ ID NO: 2318 - RNA, 27 nt, Artificial Sequence
  Description of Artificial Sequence: Synthetic oligonucleotide
ucucuauaauggugaauaucuucaaau

SEQ ID NO: 2319 - RNA, 27 nt, Artificial Sequence
  Description of Artificial Sequence: Synthetic oligonucleotide
uucucuauaauggugaauaucuucaaa

SEQ ID NO: 2320 - RNA, 27 nt, Artificial Sequence
  Description of Artificial Sequence: Synthetic oligonucleotide
guucucuauaauggugaauaucuucaa

SEQ ID NO: 2321 - RNA, 27 nt, Artificial Sequence
  Description of Artificial Sequence: Synthetic oligonucleotide
uguucucuauaauggugaauaucuuca

SEQ ID NO: 2322 - RNA, 27 nt, Artificial Sequence
  Description of Artificial Sequence: Synthetic oligonucleotide
ucuuuuaauuuguucucuauaauggug

SEQ ID NO: 2323 - RNA, 27 nt, Artificial Sequence
  Description of Artificial Sequence: Synthetic oligonucleotide
acucuuuuaauuuguucucuauaaugg

SEQ ID NO: 2324 - RNA, 27 nt, Artificial Sequence
  Description of Artificial Sequence: Synthetic oligonucleotide
aacucuuuuaauuuguucucuauaaug

SEQ ID NO: 2325 - RNA, 27 nt, Artificial Sequence
  Description of Artificial Sequence: Synthetic oligonucleotide
uaacucuuuuaauuuguucucuauaau

SEQ ID NO: 2326 - RNA, 27 nt, Artificial Sequence
  Description of Artificial Sequence: Synthetic oligonucleotide
uuaacucuuuuaauuuguucucuauaa

SEQ ID NO: 2327 - RNA, 27 nt, Artificial Sequence
  Description of Artificial Sequence: Synthetic oligonucleotide
gcaaaucacauuuauuuccuacuagga

SEQ ID NO: 2328 - RNA, 27 nt, Artificial Sequence
  Description of Artificial Sequence: Synthetic oligonucleotide
ggcaaaucacauuuauuuccuacuagg

SEQ ID NO: 2329 - RNA, 27 nt, Artificial Sequence
  Description of Artificial Sequence: Synthetic oligonucleotide
aauaaaaggaauuccauaacuucuugc

SEQ ID NO: 2330 - RNA, 27 nt, Artificial Sequence
  Description of Artificial Sequence: Synthetic oligonucleotide
uucaauaaaaggaauuccauaacuucu

SEQ ID NO: 2331 - RNA, 27 nt, Artificial Sequence
  Description of Artificial Sequence: Synthetic oligonucleotide
uuucaauaaaaggaauuccauaacuuc

SEQ ID NO: 2332 - RNA, 27 nt, Artificial Sequence
  Description of Artificial Sequence: Synthetic oligonucleotide
guuucaauaaaaggaauuccauaacuu

SEQ ID NO: 2333 - RNA, 27 nt, Artificial Sequence
  Description of Artificial Sequence: Synthetic oligonucleotide
uguuucaauaaaaggaauuccauaacu

SEQ ID NO: 2334 - RNA, 27 nt, Artificial Sequence
  Description of Artificial Sequence: Synthetic oligonucleotide
accaauguauaaaaagcauccuccacu

SEQ ID NO: 2335 - RNA, 27 nt, Artificial Sequence
  Description of Artificial Sequence: Synthetic oligonucleotide
ucaccaauguauaaaaagcauccucca

SEQ ID NO: 2336 - RNA, 27 nt, Artificial Sequence
  Description of Artificial Sequence: Synthetic oligonucleotide
ucuuugcugauuuuuuucaaucuguau

SEQ ID NO: 2337 - RNA, 27 nt, Artificial Sequence
  Description of Artificial Sequence: Synthetic oligonucleotide
uucuuugcugauuuuuuucaaucugua

SEQ ID NO: 2338 - RNA, 27 nt, Artificial Sequence
  Description of Artificial Sequence: Synthetic oligonucleotide
ucuucuuugcugauuuuuuucaaucug

SEQ ID NO: 2339 - RNA, 27 nt, Artificial Sequence
  Description of Artificial Sequence: Synthetic oligonucleotide
uucuucuuugcugauuuuuuucaaucu

SEQ ID NO: 2340 - RNA, 27 nt, Artificial Sequence
  Description of Artificial Sequence: Synthetic oligonucleotide
uuucuucuuugcugauuuuuuucaauc

SEQ ID NO: 2341 - RNA, 27 nt, Artificial Sequence
  Description of Artificial Sequence: Synthetic oligonucleotide
uuuucuucuuugcugauuuuuuucaau

SEQ ID NO: 2342 - RNA, 27 nt, Artificial Sequence
  Description of Artificial Sequence: Synthetic oligonucleotide
uuuuuuaauuuucacacagccaggagu

SEQ ID NO: 2343 - RNA, 27 nt, Artificial Sequence
  Description of Artificial Sequence: Synthetic oligonucleotide
ugcauuuuuuaauuuucacacagccag

SEQ ID NO: 2344 - RNA, 27 nt, Artificial Sequence
  Description of Artificial Sequence: Synthetic oligonucleotide
auaaugcauuuuuuaauuuucacacag

SEQ ID NO: 2345 - RNA, 27 nt, Artificial Sequence
  Description of Artificial Sequence: Synthetic oligonucleotide
uauaaugcauuuuuuaauuuucacaca

SEQ ID NO: 2346 - RNA, 27 nt, Artificial Sequence
  Description of Artificial Sequence: Synthetic oligonucleotide
uuauaaugcauuuuuuaauuuucacac

SEQ ID NO: 2347 - RNA, 27 nt, Artificial Sequence
  Description of Artificial Sequence: Synthetic oligonucleotide
auuauaaugcauuuuuuaauuuucaca

SEQ ID NO: 2348 - RNA, 27 nt, Artificial Sequence
  Description of Artificial Sequence: Synthetic oligonucleotide
acauuauaaugcauuuuuuaauuuuca

SEQ ID NO: 2349 - RNA, 27 nt, Artificial Sequence
  Description of Artificial Sequence: Synthetic oligonucleotide
uacauuauaaugcauuuuuuaauuuuc

SEQ ID NO: 2350 - RNA, 27 nt, Artificial Sequence
  Description of Artificial Sequence: Synthetic oligonucleotide
uuacauuauaaugcauuuuuuaauuuu

SEQ ID NO: 2351 - RNA, 27 nt, Artificial Sequence
  Description of Artificial Sequence: Synthetic oligonucleotide
auuacauuauaaugcauuuuuuaauuu

SEQ ID NO: 2352 - RNA, 27 nt, Artificial Sequence
  Description of Artificial Sequence: Synthetic oligonucleotide
agauuacauuauaaugcauuuuuuaau

SEQ ID NO: 2353 - RNA, 27 nt, Artificial Sequence
  Description of Artificial Sequence: Synthetic oligonucleotide
aacacccagauuacauuauaaugcauu

SEQ ID NO: 2354 - RNA, 27 nt, Artificial Sequence
  Description of Artificial Sequence: Synthetic oligonucleotide
ucuuuauguuuucgaauuucucgaacu

SEQ ID NO: 2355 - RNA, 27 nt, Artificial Sequence
  Description of Artificial Sequence: Synthetic oligonucleotide
uucuuuauguuuucgaauuucucgaac

SEQ ID NO: 2356 - RNA, 27 nt, Artificial Sequence
  Description of Artificial Sequence: Synthetic oligonucleotide
uuucuuuauguuuucgaauuucucgaa

SEQ ID NO: 2357 - RNA, 27 nt, Artificial Sequence
  Description of Artificial Sequence: Synthetic oligonucleotide
ucuuuucuuuauguuuucgaauuucuc

SEQ ID NO: 2358 - RNA, 27 nt, Artificial Sequence
  Description of Artificial Sequence: Synthetic oligonucleotide
gcucaucuuuucuuuauguuuucgaau

SEQ ID NO: 2359 - RNA, 27 nt, Artificial Sequence
  Description of Artificial Sequence: Synthetic oligonucleotide
ugcucaucuuuucuuuauguuuucgaa

SEQ ID NO: 2360 - RNA, 27 nt, Artificial Sequence
  Description of Artificial Sequence: Synthetic oligonucleotide
ucuuuuucuucuuuuuaccaucuuugc

SEQ ID NO: 2361 - RNA, 27 nt, Artificial Sequence
  Description of Artificial Sequence: Synthetic oligonucleotide
uucuuuuucuucuuuuuaccaucuuug

SEQ ID NO: 2362 - RNA, 27 nt, Artificial Sequence
  Description of Artificial Sequence: Synthetic oligonucleotide
acuucuuuuucuucuuuuuaccaucuu

SEQ ID NO: 2363 - RNA, 27 nt, Artificial Sequence
  Description of Artificial Sequence: Synthetic oligonucleotide
gacuucuuuuucuucuuuuuaccaucu

SEQ ID NO: 2364 - RNA, 27 nt, Artificial Sequence
  Description of Artificial Sequence: Synthetic oligonucleotide
ucuuugacuucuuuuucuucuuuuuac

SEQ ID NO: 2365 - RNA, 27 nt, Artificial Sequence
  Description of Artificial Sequence: Synthetic oligonucleotide
gucuuugacuucuuuuucuucuuuuua

SEQ ID NO: 2366 - RNA, 27 nt, Artificial Sequence
  Description of Artificial Sequence: Synthetic oligonucleotide
ugucuuugacuucuuuuucuucuuuuu

SEQ ID NO: 2367 - RNA, 27 nt, Artificial Sequence
  Description of Artificial Sequence: Synthetic oligonucleotide
acauaauuacacacuuugucuuugacu

SEQ ID NO: 2368 - RNA, 27 nt, Artificial Sequence
  Description of Artificial Sequence: Synthetic oligonucleotide
uacauaauuacacacuuugucuuugac

SEQ ID NO: 2369 - RNA, 27 nt, Artificial Sequence
  Description of Artificial Sequence: Synthetic oligonucleotide
uauuuacauaauuacacacuuugucuu

SEQ ID NO: 2370 - RNA, 27 nt, Artificial Sequence
  Description of Artificial Sequence: Synthetic oligonucleotide
uguauuuacauaauuacacacuuuguc

SEQ ID NO: 2371 - RNA, 27 nt, Artificial Sequence
  Description of Artificial Sequence: Synthetic oligonucleotide
aaauuguauuuacauaauuacacacuu

SEQ ID NO: 2372 - RNA, 27 nt, Artificial Sequence
  Description of Artificial Sequence: Synthetic oligonucleotide
acaaauuguauuuacauaauuacacac

SEQ ID NO: 2373 - RNA, 27 nt, Artificial Sequence
  Description of Artificial Sequence: Synthetic oligonucleotide
guacaaauuguauuuacauaauuacac

SEQ ID NO: 2374 - RNA, 27 nt, Artificial Sequence
  Description of Artificial Sequence: Synthetic oligonucleotide
aguacaaauuguauuuacauaauuaca

SEQ ID NO: 2375 - RNA, 27 nt, Artificial Sequence
  Description of Artificial Sequence: Synthetic oligonucleotide
aaaaaguacaaauuguauuuacauaau

SEQ ID NO: 2376 - RNA, 27 nt, Artificial Sequence
  Description of Artificial Sequence: Synthetic oligonucleotide
aaaaaaguacaaauuguauuuacauaa

SEQ ID NO: 2377 - RNA, 27 nt, Artificial Sequence
  Description of Artificial Sequence: Synthetic oligonucleotide
gaaaaaaguacaaauuguauuuacaua

SEQ ID NO: 2378 - RNA, 27 nt, Artificial Sequence
  Description of Artificial Sequence: Synthetic oligonucleotide
agaaaaaaguacaaauuguauuuacau

SEQ ID NO: 2379 - RNA, 27 nt, Artificial Sequence
  Description of Artificial Sequence: Synthetic oligonucleotide
gccuuaagaaaaaaguacaaauuguau

SEQ ID NO: 2380 - RNA, 27 nt, Artificial Sequence
  Description of Artificial Sequence: Synthetic oligonucleotide
ugccuuaagaaaaaaguacaaauugua

SEQ ID NO: 2381 - RNA, 27 nt, Artificial Sequence
  Description of Artificial Sequence: Synthetic oligonucleotide
acaaaaauuaccacuuguacuaguaug

SEQ ID NO: 2382 - RNA, 27 nt, Artificial Sequence
  Description of Artificial Sequence: Synthetic oligonucleotide
uacaaaaauuaccacuuguacuaguau

SEQ ID NO: 2383 - RNA, 27 nt, Artificial Sequence
  Description of Artificial Sequence: Synthetic oligonucleotide
guaauguacaaaaauuaccacuuguac

SEQ ID NO: 2384 - RNA, 27 nt, Artificial Sequence
  Description of Artificial Sequence: Synthetic oligonucleotide
uguaauguacaaaaauuaccacuugua

SEQ ID NO: 2385 - RNA, 27 nt, Artificial Sequence
  Description of Artificial Sequence: Synthetic oligonucleotide
aauuuaguguaauguacaaaaauuacc

SEQ ID NO: 2386 - RNA, 27 nt, Artificial Sequence
  Description of Artificial Sequence: Synthetic oligonucleotide
uaauuuaguguaauguacaaaaauuac

SEQ ID NO: 2387 - RNA, 27 nt, Artificial Sequence
  Description of Artificial Sequence: Synthetic oligonucleotide
auaauuuaguguaauguacaaaaauua

SEQ ID NO: 2388 - RNA, 27 nt, Artificial Sequence
  Description of Artificial Sequence: Synthetic oligonucleotide
aauaauuuaguguaauguacaaaaauu

SEQ ID NO: 2389 - RNA, 27 nt, Artificial Sequence
  Description of Artificial Sequence: Synthetic oligonucleotide
uaauaauuuaguguaauguacaaaaau

SEQ ID NO: 2390 - RNA, 27 nt, Artificial Sequence
  Description of Artificial Sequence: Synthetic oligonucleotide
uaaaacaaaugcuaauaauuuagugua

SEQ ID NO: 2391 - RNA, 27 nt, Artificial Sequence
  Description of Artificial Sequence: Synthetic oligonucleotide
gcuaaaacaaaugcuaauaauuuagug

SEQ ID NO: 2392 - RNA, 27 nt, Artificial Sequence
  Description of Artificial Sequence: Synthetic oligonucleotide
ugcuaaaacaaaugcuaauaauuuagu

SEQ ID NO: 2393 - RNA, 27 nt, Artificial Sequence
  Description of Artificial Sequence: Synthetic oligonucleotide
gguaaugcuaaaacaaaugcuaauaau

SEQ ID NO: 2394 - RNA, 27 nt, Artificial Sequence
  Description of Artificial Sequence: Synthetic oligonucleotide
aaauuagguaaugcuaaaacaaaugcu

SEQ ID NO: 2395 - RNA, 27 nt, Artificial Sequence
  Description of Artificial Sequence: Synthetic oligonucleotide
aaaauuagguaaugcuaaaacaaaugc

SEQ ID NO: 2396 - RNA, 27 nt, Artificial Sequence
  Description of Artificial Sequence: Synthetic oligonucleotide
aaaaaauuagguaaugcuaaaacaaau

SEQ ID NO: 2397 - RNA, 27 nt, Artificial Sequence
  Description of Artificial Sequence: Synthetic oligonucleotide
aaaaaaauuagguaaugcuaaaacaaa

SEQ ID NO: 2398 - RNA, 27 nt, Artificial Sequence
  Description of Artificial Sequence: Synthetic oligonucleotide
gaaaaaaauuagguaaugcuaaaacaa

SEQ ID NO: 2399 - RNA, 27 nt, Artificial Sequence
  Description of Artificial Sequence: Synthetic oligonucleotide
ggaaaaaaauuagguaaugcuaaaaca

SEQ ID NO: 2400 - RNA, 27 nt, Artificial Sequence
  Description of Artificial Sequence: Synthetic oligonucleotide
gcauuuaagguaaaagcuaacagucug

SEQ ID NO: 2401 - RNA, 27 nt, Artificial Sequence
  Description of Artificial Sequence: Synthetic oligonucleotide
agcauuuaagguaaaagcuaacagucu

SEQ ID NO: 2402 - RNA, 27 nt, Artificial Sequence
  Description of Artificial Sequence: Synthetic oligonucleotide
aaaauaagcauuuaagguaaaagcuaa

SEQ ID NO: 2403 - RNA, 27 nt, Artificial Sequence
  Description of Artificial Sequence: Synthetic oligonucleotide
uaaaauaagcauuuaagguaaaagcua

SEQ ID NO: 2404 - RNA, 27 nt, Artificial Sequence
  Description of Artificial Sequence: Synthetic oligonucleotide
uuaaaauaagcauuuaagguaaaagcu

SEQ ID NO: 2405 - RNA, 27 nt, Artificial Sequence
  Description of Artificial Sequence: Synthetic oligonucleotide
gucauuuuaaaauaagcauuuaaggua

SEQ ID NO: 2406 - RNA, 27 nt, Artificial Sequence
  Description of Artificial Sequence: Synthetic oligonucleotide
ugucauuuuaaaauaagcauuuaaggu

SEQ ID NO: 2407 - RNA, 27 nt, Artificial Sequence
  Description of Artificial Sequence: Synthetic oligonucleotide
uuccacugucauuuuaaaauaagcauu

SEQ ID NO: 2408 - RNA, 27 nt, Artificial Sequence
  Description of Artificial Sequence: Synthetic oligonucleotide
acuuccacugucauuuuaaaauaagca

SEQ ID NO: 2409 - RNA, 27 nt, Artificial Sequence
  Description of Artificial Sequence: Synthetic oligonucleotide
acuuagaggaaaaaaaaacuuccacug

SEQ ID NO: 2410 - RNA, 27 nt, Artificial Sequence
  Description of Artificial Sequence: Synthetic oligonucleotide
gcacuuagaggaaaaaaaaacuuccac

SEQ ID NO: 2411 - RNA, 27 nt, Artificial Sequence
  Description of Artificial Sequence: Synthetic oligonucleotide
ggcacuuagaggaaaaaaaaacuucca

SEQ ID NO: 2412 - RNA, 27 nt, Artificial Sequence
  Description of Artificial Sequence: Synthetic oligonucleotide
ggcauugcuaguucaaaaaccaaaacu

SEQ ID NO: 2413 - RNA, 27 nt, Artificial Sequence
  Description of Artificial Sequence: Synthetic oligonucleotide
gguauucaguuucuuuuucacaggcau

SEQ ID NO: 2414 - RNA, 27 nt, Artificial Sequence
  Description of Artificial Sequence: Synthetic oligonucleotide
aaucuuagguauucaguuucuuuuuca

SEQ ID NO: 2415 - RNA, 27 nt, Artificial Sequence
  Description of Artificial Sequence: Synthetic oligonucleotide
aaaucuuagguauucaguuucuuuuuc

SEQ ID NO: 2416 - RNA, 27 nt, Artificial Sequence
  Description of Artificial Sequence: Synthetic oligonucleotide
agacagaaaucuuagguauucaguuuc

SEQ ID NO: 2417 - RNA, 27 nt, Artificial Sequence
  Description of Artificial Sequence: Synthetic oligonucleotide
gaaaaauaagaaguaaucaacugcaug

SEQ ID NO: 2418 - RNA, 27 nt, Artificial Sequence
  Description of Artificial Sequence: Synthetic oligonucleotide
agaaaaauaagaaguaaucaacugcau

SEQ ID NO: 2419 - RNA, 27 nt, Artificial Sequence
  Description of Artificial Sequence: Synthetic oligonucleotide
gguaagaaaaauaagaaguaaucaacu

SEQ ID NO: 2420 - RNA, 27 nt, Artificial Sequence
  Description of Artificial Sequence: Synthetic oligonucleotide
ucacaauugguaagaaaaauaagaagu

SEQ ID NO: 2421 - RNA, 27 nt, Artificial Sequence
  Description of Artificial Sequence: Synthetic oligonucleotide
uucacaauugguaagaaaaauaagaag

SEQ ID NO: 2422 - RNA, 27 nt, Artificial Sequence
  Description of Artificial Sequence: Synthetic oligonucleotide
auucacaauugguaagaaaaauaagaa

SEQ ID NO: 2423 - RNA, 27 nt, Artificial Sequence
  Description of Artificial Sequence: Synthetic oligonucleotide
ucauuaauuuguuucacaccaacauuc

SEQ ID NO: 2424 - RNA, 27 nt, Artificial Sequence
  Description of Artificial Sequence: Synthetic oligonucleotide
gcuucauuaauuuguuucacaccaaca

SEQ ID NO: 2425 - RNA, 27 nt, Artificial Sequence
  Description of Artificial Sequence: Synthetic oligonucleotide
agcuucauuaauuuguuucacaccaac

SEQ ID NO: 2426 - RNA, 27 nt, Artificial Sequence
  Description of Artificial Sequence: Synthetic oligonucleotide
gauucaaaagcuucauuaauuuguuuc

SEQ ID NO: 2427 - RNA, 27 nt, Artificial Sequence
  Description of Artificial Sequence: Synthetic oligonucleotide
ugauucaaaagcuucauuaauuuguuu

SEQ ID NO: 2428 - RNA, 27 nt, Artificial Sequence
  Description of Artificial Sequence: Synthetic oligonucleotide
uuuaugugacuagauaaaacacagaau

SEQ ID NO: 2429 - RNA, 27 nt, Artificial Sequence
  Description of Artificial Sequence: Synthetic oligonucleotide
auuuaugugacuagauaaaacacagaa

SEQ ID NO: 2430 - RNA, 27 nt, Artificial Sequence
  Description of Artificial Sequence: Synthetic oligonucleotide
uccauuuaugugacuagauaaaacaca

SEQ ID NO: 2431 - RNA, 27 nt, Artificial Sequence
  Description of Artificial Sequence: Synthetic oligonucleotide
auccauuuaugugacuagauaaaacac

SEQ ID NO: 2432 - RNA, 27 nt, Artificial Sequence
  Description of Artificial Sequence: Synthetic oligonucleotide
aauuaauccauuuaugugacuagauaa

SEQ ID NO: 2433 - RNA, 27 nt, Artificial Sequence
  Description of Artificial Sequence: Synthetic oligonucleotide
uaauuaauccauuuaugugacuagaua

SEQ ID NO: 2434 - RNA, 27 nt, Artificial Sequence
  Description of Artificial Sequence: Synthetic oligonucleotide
gaaauuaguaauuaauccauuuaugug

SEQ ID NO: 2435 - RNA, 27 nt, Artificial Sequence
  Description of Artificial Sequence: Synthetic oligonucleotide
ugaaauuaguaauuaauccauuuaugu

SEQ ID NO: 2436 - RNA, 27 nt, Artificial Sequence
  Description of Artificial Sequence: Synthetic oligonucleotide
ucaacugaaauuaguaauuaauccauu

SEQ ID NO: 2437 - RNA, 27 nt, Artificial Sequence
  Description of Artificial Sequence: Synthetic oligonucleotide
ucucaacugaaauuaguaauuaaucca

SEQ ID NO: 2438 - RNA, 27 nt, Artificial Sequence
  Description of Artificial Sequence: Synthetic oligonucleotide
gucucaacugaaauuaguaauuaaucc

SEQ ID NO: 2439 - RNA, 27 nt, Artificial Sequence
  Description of Artificial Sequence: Synthetic oligonucleotide
ggucucaacugaaauuaguaauuaauc

SEQ ID NO: 2440 - RNA, 27 nt, Artificial Sequence
  Description of Artificial Sequence: Synthetic oligonucleotide
ucaauguuucaguaaaaaccaauuaga

SEQ ID NO: 2441 - RNA, 27 nt, Artificial Sequence
  Description of Artificial Sequence: Synthetic oligonucleotide
ucccucaauguuucaguaaaaaccaau

SEQ ID NO: 2442 - RNA, 27 nt, Artificial Sequence
  Description of Artificial Sequence: Synthetic oligonucleotide
uucccucaauguuucaguaaaaaccaa

SEQ ID NO: 2443 - RNA, 27 nt, Artificial Sequence
  Description of Artificial Sequence: Synthetic oligonucleotide
gcccauaaauuuguguucccucaaugu

SEQ ID NO: 2444 - RNA, 27 nt, Artificial Sequence
  Description of Artificial Sequence: Synthetic oligonucleotide
agcccauaaauuuguguucccucaaug

SEQ ID NO: 2445 - RNA, 27 nt, Artificial Sequence
  Description of Artificial Sequence: Synthetic oligonucleotide
gaacaguguaacuuuacauucaucagg

SEQ ID NO: 2446 - RNA, 27 nt, Artificial Sequence
  Description of Artificial Sequence: Synthetic oligonucleotide
ugaacaguguaacuuuacauucaucag

SEQ ID NO: 2447 - RNA, 27 nt, Artificial Sequence
  Description of Artificial Sequence: Synthetic oligonucleotide
uuauagaaaaaauauaauauuuugggg

SEQ ID NO: 2448 - RNA, 27 nt, Artificial Sequence
  Description of Artificial Sequence: Synthetic oligonucleotide
uuuauagaaaaaauauaauauuuuggg

SEQ ID NO: 2449 - RNA, 27 nt, Artificial Sequence
  Description of Artificial Sequence: Synthetic oligonucleotide
uuuuauagaaaaaauauaauauuuugg

SEQ ID NO: 2450 - RNA, 27 nt, Artificial Sequence
  Description of Artificial Sequence: Synthetic oligonucleotide
uuuuuauagaaaaaauauaauauuuug

SEQ ID NO: 2451 - RNA, 27 nt, Artificial Sequence
  Description of Artificial Sequence: Synthetic oligonucleotide
ucuuuuuauagaaaaaauauaauauuu

SEQ ID NO: 2452 - RNA, 27 nt, Artificial Sequence
  Description of Artificial Sequence: Synthetic oligonucleotide
uucuuuuuauagaaaaaauauaauauu

SEQ ID NO: 2453 - RNA, 27 nt, Artificial Sequence
  Description of Artificial Sequence: Synthetic oligonucleotide
uuucuuuuuauagaaaaaauauaauau

SEQ ID NO: 2454 - RNA, 27 nt, Artificial Sequence
  Description of Artificial Sequence: Synthetic oligonucleotide
uuuucuuuuuauagaaaaaauauaaua

SEQ ID NO: 2455 - RNA, 27 nt, Artificial Sequence
  Description of Artificial Sequence: Synthetic oligonucleotide
uuuuucuuuuuauagaaaaaauauaau

SEQ ID NO: 2456 - RNA, 27 nt, Artificial Sequence
  Description of Artificial Sequence: Synthetic oligonucleotide
uuuuuucuuuuuauagaaaaaauauaa

SEQ ID NO: 2457 - RNA, 27 nt, Artificial Sequence
  Description of Artificial Sequence: Synthetic oligonucleotide
uuuuuuucuuuuuauagaaaaaauaua

SEQ ID NO: 2458 - RNA, 27 nt, Artificial Sequence
  Description of Artificial Sequence: Synthetic oligonucleotide
auuuuuuucuuuuuauagaaaaaauau

SEQ ID NO: 2459 - RNA, 27 nt, Artificial Sequence
  Description of Artificial Sequence: Synthetic oligonucleotide
uuuccauuuuuuucuuuuuauagaaaa

SEQ ID NO: 2460 - RNA, 27 nt, Artificial Sequence
  Description of Artificial Sequence: Synthetic oligonucleotide
uuuuccauuuuuuucuuuuuauagaaa

SEQ ID NO: 2461 - RNA, 27 nt, Artificial Sequence
  Description of Artificial Sequence: Synthetic oligonucleotide
uuuuuuccauuuuuuucuuuuuauaga

SEQ ID NO: 2462 - RNA, 27 nt, Artificial Sequence
  Description of Artificial Sequence: Synthetic oligonucleotide
uuuuuuuccauuuuuuucuuuuuauag

SEQ ID NO: 2463 - RNA, 27 nt, Artificial Sequence
  Description of Artificial Sequence: Synthetic oligonucleotide
auuuuuuuccauuuuuuucuuuuuaua

SEQ ID NO: 2464 - RNA, 27 nt, Artificial Sequence
  Description of Artificial Sequence: Synthetic oligonucleotide
aauuuuuuuccauuuuuuucuuuuuau

SEQ ID NO: 2465 - RNA, 27 nt, Artificial Sequence
  Description of Artificial Sequence: Synthetic oligonucleotide
uaauuuuuuuccauuuuuuucuuuuua

SEQ ID NO: 2466 - RNA, 27 nt, Artificial Sequence
  Description of Artificial Sequence: Synthetic oligonucleotide
guaauuuuuuuccauuuuuuucuuuuu

SEQ ID NO: 2467 - RNA, 27 nt, Artificial Sequence
  Description of Artificial Sequence: Synthetic oligonucleotide
uguaauuuuuuuccauuuuuuucuuuu

SEQ ID NO: 2468 - RNA, 27 nt, Artificial Sequence
  Description of Artificial Sequence: Synthetic oligonucleotide
gccuuguaauuuuuuuccauuuuuuuc

SEQ ID NO: 2469 - RNA, 27 nt, Artificial Sequence
  Description of Artificial Sequence: Synthetic oligonucleotide
ugccuuguaauuuuuuuccauuuuuuu

SEQ ID NO: 2470 - RNA, 27 nt, Artificial Sequence
  Description of Artificial Sequence: Synthetic oligonucleotide
uccauugccuuguaauuuuuuuccauu

SEQ ID NO: 2471 - RNA, 27 nt, Artificial Sequence
  Description of Artificial Sequence: Synthetic oligonucleotide
uuccauugccuuguaauuuuuuuccau

SEQ ID NO: 2472 - RNA, 27 nt, Artificial Sequence
  Description of Artificial Sequence: Synthetic oligonucleotide
uuuccauugccuuguaauuuuuuucca

SEQ ID NO: 2473 - RNA, 27 nt, Artificial Sequence
  Description of Artificial Sequence: Synthetic oligonucleotide
uuaucuaaugugaaaaggaaauggccu

SEQ ID NO: 2474 - RNA, 27 nt, Artificial Sequence
  Description of Artificial Sequence: Synthetic oligonucleotide
aguaauuuaucuaaugugaaaaggaaa

SEQ ID NO: 2475 - RNA, 27 nt, Artificial Sequence
  Description of Artificial Sequence: Synthetic oligonucleotide
ucuuuauaguaauuuaucuaaugugaa

SEQ ID NO: 2476 - RNA, 27 nt, Artificial Sequence
  Description of Artificial Sequence: Synthetic oligonucleotide
gucuuuauaguaauuuaucuaauguga

SEQ ID NO: 2477 - RNA, 27 nt, Artificial Sequence
  Description of Artificial Sequence: Synthetic oligonucleotide
agucuuuauaguaauuuaucuaaugug

SEQ ID NO: 2478 - RNA, 27 nt, Artificial Sequence
  Description of Artificial Sequence: Synthetic oligonucleotide
gcuauaauaauccccauuucauacugg

SEQ ID NO: 2479 - RNA, 27 nt, Artificial Sequence
  Description of Artificial Sequence: Synthetic oligonucleotide
aaaaugguugcuauaauaauccccauu

SEQ ID NO: 2480 - RNA, 27 nt, Artificial Sequence
  Description of Artificial Sequence: Synthetic oligonucleotide
aauuuaguagcauguaaauauagcccc

SEQ ID NO: 2481 - RNA, 27 nt, Artificial Sequence
  Description of Artificial Sequence: Synthetic oligonucleotide
aaauuuaguagcauguaaauauagccc

SEQ ID NO: 2482 - RNA, 27 nt, Artificial Sequence
  Description of Artificial Sequence: Synthetic oligonucleotide
aaaauuuaguagcauguaaauauagcc

SEQ ID NO: 2483 - RNA, 27 nt, Artificial Sequence
  Description of Artificial Sequence: Synthetic oligonucleotide
aaaaauuuaguagcauguaaauauagc

SEQ ID NO: 2484 - RNA, 27 nt, Artificial Sequence
  Description of Artificial Sequence: Synthetic oligonucleotide
uaaaaauuuaguagcauguaaauauag

SEQ ID NO: 2485 - RNA, 27 nt, Artificial Sequence
  Description of Artificial Sequence: Synthetic oligonucleotide
uauuauaaaaauuuaguagcauguaaa

SEQ ID NO: 2486 - RNA, 27 nt, Artificial Sequence
  Description of Artificial Sequence: Synthetic oligonucleotide
uuucaauuauuauaaaaauuuaguagc

SEQ ID NO: 2487 - RNA, 27 nt, Artificial Sequence
  Description of Artificial Sequence: Synthetic oligonucleotide
uuuucaauuauuauaaaaauuuaguag

SEQ ID NO: 2488 - RNA, 27 nt, Artificial Sequence
  Description of Artificial Sequence: Synthetic oligonucleotide
ucuuuucaauuauuauaaaaauuuagu

SEQ ID NO: 2489 - RNA, 27 nt, Artificial Sequence
  Description of Artificial Sequence: Synthetic oligonucleotide
aucuuuucaauuauuauaaaaauuuag

SEQ ID NO: 2490 - RNA, 27 nt, Artificial Sequence
  Description of Artificial Sequence: Synthetic oligonucleotide
aaucuuuucaauuauuauaaaaauuua

SEQ ID NO: 2491 - RNA, 27 nt, Artificial Sequence
  Description of Artificial Sequence: Synthetic oligonucleotide
aaaucuuuucaauuauuauaaaaauuu

SEQ ID NO: 2492 - RNA, 27 nt, Artificial Sequence
  Description of Artificial Sequence: Synthetic oligonucleotide
aaaaucuuuucaauuauuauaaaaauu

SEQ ID NO: 2493 - RNA, 27 nt, Artificial Sequence
  Description of Artificial Sequence: Synthetic oligonucleotide
uaaaaucuuuucaauuauuauaaaaau

SEQ ID NO: 2494 - RNA, 27 nt, Artificial Sequence
  Description of Artificial Sequence: Synthetic oligonucleotide
uuaaaaucuuuucaauuauuauaaaaa

SEQ ID NO: 2495 - RNA, 27 nt, Artificial Sequence
  Description of Artificial Sequence: Synthetic oligonucleotide
guuaaaaucuuuucaauuauuauaaaa

SEQ ID NO: 2496 - RNA, 27 nt, Artificial Sequence
  Description of Artificial Sequence: Synthetic oligonucleotide
uguuaaaaucuuuucaauuauuauaaa

SEQ ID NO: 2497 - RNA, 27 nt, Artificial Sequence
  Description of Artificial Sequence: Synthetic oligonucleotide
uacuuguuaaaaucuuuucaauuauua

SEQ ID NO: 2498 - RNA, 27 nt, Artificial Sequence
  Description of Artificial Sequence: Synthetic oligonucleotide
auacuuguuaaaaucuuuucaauuauu

SEQ ID NO: 2499 - RNA, 27 nt, Artificial Sequence
  Description of Artificial Sequence: Synthetic oligonucleotide
uuauacuuguuaaaaucuuuucaauua

SEQ ID NO: 2500 - RNA, 27 nt, Artificial Sequence
  Description of Artificial Sequence: Synthetic oligonucleotide
uuuauacuuguuaaaaucuuuucaauu

SEQ ID NO: 2501 - RNA, 27 nt, Artificial Sequence
  Description of Artificial Sequence: Synthetic oligonucleotide
uuuuauacuuguuaaaaucuuuucaau

SEQ ID NO: 2502 - RNA, 27 nt, Artificial Sequence
  Description of Artificial Sequence: Synthetic oligonucleotide
uuuuuauacuuguuaaaaucuuuucaa

SEQ ID NO: 2503 - RNA, 27 nt, Artificial Sequence
  Description of Artificial Sequence: Synthetic oligonucleotide
uuuuuuauacuuguuaaaaucuuuuca

SEQ ID NO: 2504 - RNA, 27 nt, Artificial Sequence
  Description of Artificial Sequence: Synthetic oligonucleotide
auuuuuuauacuuguuaaaaucuuuuc

SEQ ID NO: 2505 - RNA, 27 nt, Artificial Sequence
  Description of Artificial Sequence: Synthetic oligonucleotide
aauuuuuuauacuuguuaaaaucuuuu

SEQ ID NO: 2506 - RNA, 27 nt, Artificial Sequence
  Description of Artificial Sequence: Synthetic oligonucleotide
gaauuuuuuauacuuguuaaaaucuuu

SEQ ID NO: 2507 - RNA, 27 nt, Artificial Sequence
  Description of Artificial Sequence: Synthetic oligonucleotide
agaauuuuuuauacuuguuaaaaucuu

SEQ ID NO: 2508 - RNA, 27 nt, Artificial Sequence
  Description of Artificial Sequence: Synthetic oligonucleotide
uccuaugagaauuuuuuauacuuguua

SEQ ID NO: 2509 - RNA, 27 nt, Artificial Sequence
  Description of Artificial Sequence: Synthetic oligonucleotide
uuccuaugagaauuuuuuauacuuguu

SEQ ID NO: 2510 - RNA, 27 nt, Artificial Sequence
  Description of Artificial Sequence: Synthetic oligonucleotide
auuccuaugagaauuuuuuauacuugu

SEQ ID NO: 2511 - RNA, 27 nt, Artificial Sequence
  Description of Artificial Sequence: Synthetic oligonucleotide
aauuccuaugagaauuuuuuauacuug

SEQ ID NO: 2512 - RNA, 27 nt, Artificial Sequence
  Description of Artificial Sequence: Synthetic oligonucleotide
uaauuccuaugagaauuuuuuauacuu

SEQ ID NO: 2513 - RNA, 27 nt, Artificial Sequence
  Description of Artificial Sequence: Synthetic oligonucleotide
uuaauuccuaugagaauuuuuuauacu

SEQ ID NO: 2514 - RNA, 27 nt, Artificial Sequence
  Description of Artificial Sequence: Synthetic oligonucleotide
uuuaauuccuaugagaauuuuuuauac

SEQ ID NO: 2515 - RNA, 27 nt, Artificial Sequence
  Description of Artificial Sequence: Synthetic oligonucleotide
auuuaauuccuaugagaauuuuuuaua

SEQ ID NO: 2516 - RNA, 27 nt, Artificial Sequence
  Description of Artificial Sequence: Synthetic oligonucleotide
acauuuaauuccuaugagaauuuuuua

SEQ ID NO: 2517 - RNA, 27 nt, Artificial Sequence
  Description of Artificial Sequence: Synthetic oligonucleotide
uacauuuaauuccuaugagaauuuuuu

SEQ ID NO: 2518 - RNA, 27 nt, Artificial Sequence
  Description of Artificial Sequence: Synthetic oligonucleotide
gauuuaaaguuauacuaugaaagagca

SEQ ID NO: 2519 - RNA, 27 nt, Artificial Sequence
  Description of Artificial Sequence: Synthetic oligonucleotide
gaaaagauuuaaaguuauacuaugaaa

SEQ ID NO: 2520 - RNA, 27 nt, Artificial Sequence
  Description of Artificial Sequence: Synthetic oligonucleotide
agaaaagauuuaaaguuauacuaugaa

SEQ ID NO: 2521 - RNA, 27 nt, Artificial Sequence
  Description of Artificial Sequence: Synthetic oligonucleotide
acucaaguugaagaaaagauuuaaagu

SEQ ID NO: 2522 - RNA, 27 nt, Artificial Sequence
  Description of Artificial Sequence: Synthetic oligonucleotide
gacucaaguugaagaaaagauuuaaag

SEQ ID NO: 2523 - RNA, 27 nt, Artificial Sequence
  Description of Artificial Sequence: Synthetic oligonucleotide
aaaacuaucuucaaagacucaaguuga

SEQ ID NO: 2524 - RNA, 27 nt, Artificial Sequence
  Description of Artificial Sequence: Synthetic oligonucleotide
uuaaaacuaucuucaaagacucaaguu

SEQ ID NO: 2525 - RNA, 27 nt, Artificial Sequence
  Description of Artificial Sequence: Synthetic oligonucleotide
auuaaaacuaucuucaaagacucaagu

SEQ ID NO: 2526 - RNA, 27 nt, Artificial Sequence
  Description of Artificial Sequence: Synthetic oligonucleotide
ucacaagcagaauuaaaacuaucuuca

SEQ ID NO: 2527 - RNA, 27 nt, Artificial Sequence
  Description of Artificial Sequence: Synthetic oligonucleotide
gucacaagcagaauuaaaacuaucuuc

SEQ ID NO: 2528 - RNA, 27 nt, Artificial Sequence
  Description of Artificial Sequence: Synthetic oligonucleotide
ugucacaagcagaauuaaaacuaucuu

SEQ ID NO: 2529 - RNA, 27 nt, Artificial Sequence
  Description of Artificial Sequence: Synthetic oligonucleotide
aaauaaucuuuuaaugucacaagcaga

SEQ ID NO: 2530 - RNA, 27 nt, Artificial Sequence
  Description of Artificial Sequence: Synthetic oligonucleotide
uuucuuaagaaacaaaagcaaugcucu

SEQ ID NO: 2531 - RNA, 27 nt, Artificial Sequence
  Description of Artificial Sequence: Synthetic oligonucleotide
uuuucuuaagaaacaaaagcaaugcuc

SEQ ID NO: 2532 - RNA, 27 nt, Artificial Sequence
  Description of Artificial Sequence: Synthetic oligonucleotide
aguuuguuuucuuaagaaacaaaagca

SEQ ID NO: 2533 - RNA, 27 nt, Artificial Sequence
  Description of Artificial Sequence: Synthetic oligonucleotide
aaaaaagaguuuguuuucuuaagaaac

SEQ ID NO: 2534 - RNA, 27 nt, Artificial Sequence
  Description of Artificial Sequence: Synthetic oligonucleotide
uaaaaaagaguuuguuuucuuaagaaa

SEQ ID NO: 2535 - RNA, 27 nt, Artificial Sequence
  Description of Artificial Sequence: Synthetic oligonucleotide
uuaaaaaagaguuuguuuucuuaagaa

SEQ ID NO: 2536 - RNA, 27 nt, Artificial Sequence
  Description of Artificial Sequence: Synthetic oligonucleotide
uuuaaaaaagaguuuguuuucuuaaga

SEQ ID NO: 2537 - RNA, 27 nt, Artificial Sequence
  Description of Artificial Sequence: Synthetic oligonucleotide
uuuuaaaaaagaguuuguuuucuuaag

SEQ ID NO: 2538 - RNA, 27 nt, Artificial Sequence
  Description of Artificial Sequence: Synthetic oligonucleotide
uuuuuaaaaaagaguuuguuuucuuaa

SEQ ID NO: 2539 - RNA, 27 nt, Artificial Sequence
  Description of Artificial Sequence: Synthetic oligonucleotide
auuuuuaaaaaagaguuuguuuucuua

SEQ ID NO: 2540 - RNA, 27 nt, Artificial Sequence
  Description of Artificial Sequence: Synthetic oligonucleotide
aguaauuuuuaaaaaagaguuuguuuu

SEQ ID NO: 2541 - RNA, 27 nt, Artificial Sequence
  Description of Artificial Sequence: Synthetic oligonucleotide
uuuaaaaguaauuuuuaaaaaagaguu

SEQ ID NO: 2542 - RNA, 27 nt, Artificial Sequence
  Description of Artificial Sequence: Synthetic oligonucleotide
auuuaaaaguaauuuuuaaaaaagagu

SEQ ID NO: 2543 - RNA, 27 nt, Artificial Sequence
  Description of Artificial Sequence: Synthetic oligonucleotide
uauuuaaaaguaauuuuuaaaaaagag

SEQ ID NO: 2544 - RNA, 27 nt, Artificial Sequence
  Description of Artificial Sequence: Synthetic oligonucleotide
auauuuaaaaguaauuuuuaaaaaaga

SEQ ID NO: 2545 - RNA, 27 nt, Artificial Sequence
  Description of Artificial Sequence: Synthetic oligonucleotide
aauauuuaaaaguaauuuuuaaaaaag

SEQ ID NO: 2546 - RNA, 27 nt, Artificial Sequence
  Description of Artificial Sequence: Synthetic oligonucleotide
uaauauuuaaaaguaauuuuuaaaaaa

SEQ ID NO: 2547 - RNA, 27 nt, Artificial Sequence
  Description of Artificial Sequence: Synthetic oligonucleotide
uuaauauuuaaaaguaauuuuuaaaaa

SEQ ID NO: 2548 - RNA, 27 nt, Artificial Sequence
  Description of Artificial Sequence: Synthetic oligonucleotide
guuaauauuuaaaaguaauuuuuaaaa

SEQ ID NO: 2549 - RNA, 27 nt, Artificial Sequence
  Description of Artificial Sequence: Synthetic oligonucleotide
aguuaauauuuaaaaguaauuuuuaaa

SEQ ID NO: 2550 - RNA, 27 nt, Artificial Sequence
  Description of Artificial Sequence: Synthetic oligonucleotide
acuuuugaguuaauauuuaaaaguaau

SEQ ID NO: 2551 - RNA, 27 nt, Artificial Sequence
  Description of Artificial Sequence: Synthetic oligonucleotide
aacuuuugaguuaauauuuaaaaguaa

SEQ ID NO: 2552 - RNA, 27 nt, Artificial Sequence
  Description of Artificial Sequence: Synthetic oligonucleotide
ucaacuuuugaguuaauauuuaaaagu

SEQ ID NO: 2553 - RNA, 27 nt, Artificial Sequence
  Description of Artificial Sequence: Synthetic oligonucleotide
ucucaacuuuugaguuaauauuuaaaa

SEQ ID NO: 2554 - RNA, 27 nt, Artificial Sequence
  Description of Artificial Sequence: Synthetic oligonucleotide
aucucaacuuuugaguuaauauuuaaa

SEQ ID NO: 2555 - RNA, 27 nt, Artificial Sequence
  Description of Artificial Sequence: Synthetic oligonucleotide
aaucucaacuuuugaguuaauauuuaa

SEQ ID NO: 2556 - RNA, 27 nt, Artificial Sequence
  Description of Artificial Sequence: Synthetic oligonucleotide
aaaucucaacuuuugaguuaauauuua

SEQ ID NO: 2557 - RNA, 27 nt, Artificial Sequence
  Description of Artificial Sequence: Synthetic oligonucleotide
aaaaaaauuaaugucuuggcacaccac

SEQ ID NO: 2558 - RNA, 27 nt, Artificial Sequence
  Description of Artificial Sequence: Synthetic oligonucleotide
uuaaaaaaaaaauuaaugucuuggcac

SEQ ID NO: 2559 - RNA, 27 nt, Artificial Sequence
  Description of Artificial Sequence: Synthetic oligonucleotide
uuuaaaaaaaaaauuaaugucuuggca

SEQ ID NO: 2560 - RNA, 27 nt, Artificial Sequence
  Description of Artificial Sequence: Synthetic oligonucleotide
ucauuguuuaaaaaaaaaauuaauguc

SEQ ID NO: 2561 - RNA, 27 nt, Artificial Sequence
  Description of Artificial Sequence: Synthetic oligonucleotide
uucauuguuuaaaaaaaaaauuaaugu

SEQ ID NO: 2562 - RNA, 27 nt, Artificial Sequence
  Description of Artificial Sequence: Synthetic oligonucleotide
acuucauuguuuaaaaaaaaaauuaau

SEQ ID NO: 2563 - RNA, 27 nt, Artificial Sequence
  Description of Artificial Sequence: Synthetic oligonucleotide
ucacuucauuguuuaaaaaaaaaauua

SEQ ID NO: 2564 - RNA, 27 nt, Artificial Sequence
  Description of Artificial Sequence: Synthetic oligonucleotide
uucacuucauuguuuaaaaaaaaaauu

SEQ ID NO: 2565 - RNA, 27 nt, Artificial Sequence
  Description of Artificial Sequence: Synthetic oligonucleotide
uuucacuucauuguuuaaaaaaaaaau

SEQ ID NO: 2566 - RNA, 27 nt, Artificial Sequence
  Description of Artificial Sequence: Synthetic oligonucleotide
uuuucacuucauuguuuaaaaaaaaaa

SEQ ID NO: 2567 - RNA, 27 nt, Artificial Sequence
  Description of Artificial Sequence: Synthetic oligonucleotide
uuuuucacuucauuguuuaaaaaaaaa

SEQ ID NO: 2568 - RNA, 27 nt, Artificial Sequence
  Description of Artificial Sequence: Synthetic oligonucleotide
acuuuuucacuucauuguuuaaaaaaa

SEQ ID NO: 2569 - RNA, 27 nt, Artificial Sequence
  Description of Artificial Sequence: Synthetic oligonucleotide
aacuuuuucacuucauuguuuaaaaaa

SEQ ID NO: 2570 - RNA, 27 nt, Artificial Sequence
  Description of Artificial Sequence: Synthetic oligonucleotide
aaacuuuuucacuucauuguuuaaaaa

SEQ ID NO: 2571 - RNA, 27 nt, Artificial Sequence
  Description of Artificial Sequence: Synthetic oligonucleotide
agauuguaaaacuuuuucacuucauug

SEQ ID NO: 2572 - RNA, 27 nt, Artificial Sequence
  Description of Artificial Sequence: Synthetic oligonucleotide
accuagagauuguaaaacuuuuucacu

SEQ ID NO: 2573 - RNA, 27 nt, Artificial Sequence
  Description of Artificial Sequence: Synthetic oligonucleotide
aaccuagagauuguaaaacuuuuucac

SEQ ID NO: 2574 - RNA, 27 nt, Artificial Sequence
  Description of Artificial Sequence: Synthetic oligonucleotide
aaaccuagagauuguaaaacuuuuuca

SEQ ID NO: 2575 - RNA, 27 nt, Artificial Sequence
  Description of Artificial Sequence: Synthetic oligonucleotide
uuuaugcaauguuaauuuaaccagugu

SEQ ID NO: 2576 - RNA, 27 nt, Artificial Sequence
  Description of Artificial Sequence: Synthetic oligonucleotide
guuuaugcaauguuaauuuaaccagug

SEQ ID NO: 2577 - RNA, 27 nt, Artificial Sequence
  Description of Artificial Sequence: Synthetic oligonucleotide
uguuuaugcaauguuaauuuaaccagu

SEQ ID NO: 2578 - RNA, 27 nt, Artificial Sequence
  Description of Artificial Sequence: Synthetic oligonucleotide
gacuugaaaaguguuuaugcaauguua

SEQ ID NO: 2579 - RNA, 27 nt, Artificial Sequence
  Description of Artificial Sequence: Synthetic oligonucleotide
auuauuaaauauggaucagacuugaaa

SEQ ID NO: 2580 - RNA, 27 nt, Artificial Sequence
  Description of Artificial Sequence: Synthetic oligonucleotide
auuuuaaagcauuauuaaauauggauc

SEQ ID NO: 2581 - RNA, 27 nt, Artificial Sequence
  Description of Artificial Sequence: Synthetic oligonucleotide
uauuuuaaagcauuauuaaauauggau

SEQ ID NO: 2582 - RNA, 27 nt, Artificial Sequence
  Description of Artificial Sequence: Synthetic oligonucleotide
uuauuuuaaagcauuauuaaauaugga

SEQ ID NO: 2583 - RNA, 27 nt, Artificial Sequence
  Description of Artificial Sequence: Synthetic oligonucleotide
uuuauuuuaaagcauuauuaaauaugg

SEQ ID NO: 2584 - RNA, 27 nt, Artificial Sequence
  Description of Artificial Sequence: Synthetic oligonucleotide
uuuuauuuuaaagcauuauuaaauaug

SEQ ID NO: 2585 - RNA, 27 nt, Artificial Sequence
  Description of Artificial Sequence: Synthetic oligonucleotide
uuuuuauuuuaaagcauuauuaaauau

SEQ ID NO: 2586 - RNA, 27 nt, Artificial Sequence
  Description of Artificial Sequence: Synthetic oligonucleotide
uauuuuuauuuuaaagcauuauuaaau

SEQ ID NO: 2587 - RNA, 27 nt, Artificial Sequence
  Description of Artificial Sequence: Synthetic oligonucleotide
uuauuuuuauuuuaaagcauuauuaaa

SEQ ID NO: 2588 - RNA, 27 nt, Artificial Sequence
  Description of Artificial Sequence: Synthetic oligonucleotide
uuuauuuuuauuuuaaagcauuauuaa

SEQ ID NO: 2589 - RNA, 27 nt, Artificial Sequence
  Description of Artificial Sequence: Synthetic oligonucleotide
uuuuauuuuuauuuuaaagcauuauua

SEQ ID NO: 2590 - RNA, 27 nt, Artificial Sequence
  Description of Artificial Sequence: Synthetic oligonucleotide
ggauuguuuuuauuuuuauuuuaaagc

SEQ ID NO: 2591 - RNA, 27 nt, Artificial Sequence
  Description of Artificial Sequence: Synthetic oligonucleotide
ucaaaaggauuguuuuuauuuuuauuu

SEQ ID NO: 2592 - RNA, 27 nt, Artificial Sequence
  Description of Artificial Sequence: Synthetic oligonucleotide
aucaaaaggauuguuuuuauuuuuauu

SEQ ID NO: 2593 - RNA, 27 nt, Artificial Sequence
  Description of Artificial Sequence: Synthetic oligonucleotide
uaucaaaaggauuguuuuuauuuuuau

SEQ ID NO: 2594 - RNA, 27 nt, Artificial Sequence
  Description of Artificial Sequence: Synthetic oligonucleotide
uuaucaaaaggauuguuuuuauuuuua

SEQ ID NO: 2595 - RNA, 27 nt, Artificial Sequence
  Description of Artificial Sequence: Synthetic oligonucleotide
uuuaucaaaaggauuguuuuuauuuuu

SEQ ID NO: 2596 - RNA, 27 nt, Artificial Sequence
  Description of Artificial Sequence: Synthetic oligonucleotide
auuuaucaaaaggauuguuuuuauuuu

SEQ ID NO: 2597 - RNA, 27 nt, Artificial Sequence
  Description of Artificial Sequence: Synthetic oligonucleotide
aauuuaucaaaaggauuguuuuuauuu

SEQ ID NO: 2598 - RNA, 27 nt, Artificial Sequence
  Description of Artificial Sequence: Synthetic oligonucleotide
aaauuuaucaaaaggauuguuuuuauu

SEQ ID NO: 2599 - RNA, 27 nt, Artificial Sequence
  Description of Artificial Sequence: Synthetic oligonucleotide
uuuuaaauuuaucaaaaggauuguuuu

SEQ ID NO: 2600 - RNA, 27 nt, Artificial Sequence
  Description of Artificial Sequence: Synthetic oligonucleotide
uaacauuuuaaauuuaucaaaaggauu

SEQ ID NO: 2601 - RNA, 27 nt, Artificial Sequence
  Description of Artificial Sequence: Synthetic oligonucleotide
guaacauuuuaaauuuaucaaaaggau

SEQ ID NO: 2602 - RNA, 27 nt, Artificial Sequence
  Description of Artificial Sequence: Synthetic oligonucleotide
aguaacauuuuaaauuuaucaaaagga

SEQ ID NO: 2603 - RNA, 27 nt, Artificial Sequence
  Description of Artificial Sequence: Synthetic oligonucleotide
aauaaguaacauuuuaaauuuaucaaa

SEQ ID NO: 2604 - RNA, 27 nt, Artificial Sequence
  Description of Artificial Sequence: Synthetic oligonucleotide
aaauaaguaacauuuuaaauuuaucaa

SEQ ID NO: 2605 - RNA, 27 nt, Artificial Sequence
  Description of Artificial Sequence: Synthetic oligonucleotide
aaaauaaguaacauuuuaaauuuauca

SEQ ID NO: 2606 - RNA, 27 nt, Artificial Sequence
  Description of Artificial Sequence: Synthetic oligonucleotide
uaaaauaaguaacauuuuaaauuuauc

SEQ ID NO: 2607 - RNA, 27 nt, Artificial Sequence
  Description of Artificial Sequence: Synthetic oligonucleotide
uuaaaauaaguaacauuuuaaauuuau

SEQ ID NO: 2608 - RNA, 27 nt, Artificial Sequence
  Description of Artificial Sequence: Synthetic oligonucleotide
uuuaaaauaaguaacauuuuaaauuua

SEQ ID NO: 2609 - RNA, 27 nt, Artificial Sequence
  Description of Artificial Sequence: Synthetic oligonucleotide
auuuuaaaauaaguaacauuuuaaauu

SEQ ID NO: 2610 - RNA, 27 nt, Artificial Sequence
  Description of Artificial Sequence: Synthetic oligonucleotide
uauuuuaaaauaaguaacauuuuaaau

SEQ ID NO: 2611 - RNA, 27 nt, Artificial Sequence
  Description of Artificial Sequence: Synthetic oligonucleotide
uuauuuuaaaauaaguaacauuuuaaa

SEQ ID NO: 2612 - RNA, 27 nt, Artificial Sequence
  Description of Artificial Sequence: Synthetic oligonucleotide
uuuauuuuaaaauaaguaacauuuuaa

SEQ ID NO: 2613 - RNA, 27 nt, Artificial Sequence
  Description of Artificial Sequence: Synthetic oligonucleotide
auuuauuuuaaaauaaguaacauuuua

SEQ ID NO: 2614 - RNA, 27 nt, Artificial Sequence
  Description of Artificial Sequence: Synthetic oligonucleotide
ucauuuauuuuaaaauaaguaacauuu

SEQ ID NO: 2615 - RNA, 27 nt, Artificial Sequence
  Description of Artificial Sequence: Synthetic oligonucleotide
ucacuucauuuauuuuaaaauaaguaa

SEQ ID NO: 2616 - RNA, 27 nt, Artificial Sequence
  Description of Artificial Sequence: Synthetic oligonucleotide
ucucacuucauuuauuuuaaaauaagu

SEQ ID NO: 2617 - RNA, 27 nt, Artificial Sequence
  Description of Artificial Sequence: Synthetic oligonucleotide
aucucacuucauuuauuuuaaaauaag

SEQ ID NO: 2618 - RNA, 27 nt, Artificial Sequence
  Description of Artificial Sequence: Synthetic oligonucleotide
gccaucucacuucauuuauuuuaaaau

SEQ ID NO: 2619 - RNA, 27 nt, Artificial Sequence
  Description of Artificial Sequence: Synthetic oligonucleotide
ugccaucucacuucauuuauuuuaaaa

SEQ ID NO: 2620 - RNA, 27 nt, Artificial Sequence
  Description of Artificial Sequence: Synthetic oligonucleotide
acuucuuuuaacaugaagaaauggaua

SEQ ID NO: 2621 - RNA, 27 nt, Artificial Sequence
  Description of Artificial Sequence: Synthetic oligonucleotide
gacuucuuuuaacaugaagaaauggau

SEQ ID NO: 2622 - RNA, 27 nt, Artificial Sequence
  Description of Artificial Sequence: Synthetic oligonucleotide
aaaaaaaaaaaacuaagaguuugagau

SEQ ID NO: 2623 - RNA, 27 nt, Artificial Sequence
  Description of Artificial Sequence: Synthetic oligonucleotide
acauaguuguaaaaaaaaaaaacuaag

SEQ ID NO: 2624 - RNA, 27 nt, Artificial Sequence
  Description of Artificial Sequence: Synthetic oligonucleotide
uacauaguuguaaaaaaaaaaaacuaa

SEQ ID NO: 2625 - RNA, 27 nt, Artificial Sequence
  Description of Artificial Sequence: Synthetic oligonucleotide
uuacauaguuguaaaaaaaaaaaacua

SEQ ID NO: 2626 - RNA, 27 nt, Artificial Sequence
  Description of Artificial Sequence: Synthetic oligonucleotide
auuacauaguuguaaaaaaaaaaaacu

SEQ ID NO: 2627 - RNA, 27 nt, Artificial Sequence
  Description of Artificial Sequence: Synthetic oligonucleotide
aauuacauaguuguaaaaaaaaaaaac

SEQ ID NO: 2628 - RNA, 27 nt, Artificial Sequence
  Description of Artificial Sequence: Synthetic oligonucleotide
aaauuacauaguuguaaaaaaaaaaaa

SEQ ID NO: 2629 - RNA, 27 nt, Artificial Sequence
  Description of Artificial Sequence: Synthetic oligonucleotide
uaaauuacauaguuguaaaaaaaaaaa

SEQ ID NO: 2630 - RNA, 27 nt, Artificial Sequence
  Description of Artificial Sequence: Synthetic oligonucleotide
auaaauuacauaguuguaaaaaaaaaa

SEQ ID NO: 2631 - RNA, 27 nt, Artificial Sequence
  Description of Artificial Sequence: Synthetic oligonucleotide
uauaaauuacauaguuguaaaaaaaaa

SEQ ID NO: 2632 - RNA, 27 nt, Artificial Sequence
  Description of Artificial Sequence: Synthetic oligonucleotide
auauaaauuacauaguuguaaaaaaaa

SEQ ID NO: 2633 - RNA, 27 nt, Artificial Sequence
  Description of Artificial Sequence: Synthetic oligonucleotide
aauauaaauuacauaguuguaaaaaaa

SEQ ID NO: 2634 - RNA, 27 nt, Artificial Sequence
  Description of Artificial Sequence: Synthetic oligonucleotide
uaaauggaauauaaauuacauaguugu

SEQ ID NO: 2635 - RNA, 27 nt, Artificial Sequence
  Description of Artificial Sequence: Synthetic oligonucleotide
guaaauggaauauaaauuacauaguug

SEQ ID NO: 2636 - RNA, 27 nt, Artificial Sequence
  Description of Artificial Sequence: Synthetic oligonucleotide
uguaaauggaauauaaauuacauaguu

SEQ ID NO: 2637 - RNA, 27 nt, Artificial Sequence
  Description of Artificial Sequence: Synthetic oligonucleotide
uccuuauguaaauggaauauaaauuac

SEQ ID NO: 2638 - RNA, 27 nt, Artificial Sequence
  Description of Artificial Sequence: Synthetic oligonucleotide
auccuuauguaaauggaauauaaauua

SEQ ID NO: 2639 - RNA, 27 nt, Artificial Sequence
  Description of Artificial Sequence: Synthetic oligonucleotide
uauccuuauguaaauggaauauaaauu

SEQ ID NO: 2640 - RNA, 27 nt, Artificial Sequence
  Description of Artificial Sequence: Synthetic oligonucleotide
guauccuuauguaaauggaauauaaau

SEQ ID NO: 2641 - RNA, 27 nt, Artificial Sequence
  Description of Artificial Sequence: Synthetic oligonucleotide
ugacaaauaaguguauccuuauguaaa

SEQ ID NO: 2642 - RNA, 27 nt, Artificial Sequence
  Description of Artificial Sequence: Synthetic oligonucleotide
agcuugacaaauaaguguauccuuaug

SEQ ID NO: 2643 - RNA, 27 nt, Artificial Sequence
  Description of Artificial Sequence: Synthetic oligonucleotide
uaacauagguuaaaaauuuacagauug

SEQ ID NO: 2644 - RNA, 27 nt, Artificial Sequence
  Description of Artificial Sequence: Synthetic oligonucleotide
guaacauagguuaaaaauuuacagauu

SEQ ID NO: 2645 - RNA, 27 nt, Artificial Sequence
  Description of Artificial Sequence: Synthetic oligonucleotide
uguaacauagguuaaaaauuuacagau

SEQ ID NO: 2646 - RNA, 27 nt, Artificial Sequence
  Description of Artificial Sequence: Synthetic oligonucleotide
ucaaauauaaacuucaccucuugcaca

SEQ ID NO: 2647 - RNA, 27 nt, Artificial Sequence
  Description of Artificial Sequence: Synthetic oligonucleotide
auucaaauauaaacuucaccucuugca

SEQ ID NO: 2648 - RNA, 27 nt, Artificial Sequence
  Description of Artificial Sequence: Synthetic oligonucleotide
uauucaaauauaaacuucaccucuugc

SEQ ID NO: 2649 - RNA, 27 nt, Artificial Sequence
  Description of Artificial Sequence: Synthetic oligonucleotide
gauauucaaauauaaacuucaccucuu

SEQ ID NO: 2650 - RNA, 27 nt, Artificial Sequence
  Description of Artificial Sequence: Synthetic oligonucleotide
ggauauucaaauauaaacuucaccucu

SEQ ID NO: 2651 - RNA, 27 nt, Artificial Sequence
  Description of Artificial Sequence: Synthetic oligonucleotide
agaauggauauucaaauauaaacuuca

SEQ ID NO: 2652 - RNA, 27 nt, Artificial Sequence
  Description of Artificial Sequence: Synthetic oligonucleotide
uacaaguauuaaaacugcaucaaguca

SEQ ID NO: 2653 - RNA, 27 nt, Artificial Sequence
  Description of Artificial Sequence: Synthetic oligonucleotide
auuacaaguauuaaaacugcaucaagu

SEQ ID NO: 2654 - RNA, 27 nt, Artificial Sequence
  Description of Artificial Sequence: Synthetic oligonucleotide
ugaaaauuagugauuaggucaaauccc

SEQ ID NO: 2655 - RNA, 27 nt, Artificial Sequence
  Description of Artificial Sequence: Synthetic oligonucleotide
accaccugaaaauuagugauuagguca

SEQ ID NO: 2656 - RNA, 27 nt, Artificial Sequence
  Description of Artificial Sequence: Synthetic oligonucleotide
auaccagguuugaaaaauccuacuguc

SEQ ID NO: 2657 - RNA, 27 nt, Artificial Sequence
  Description of Artificial Sequence: Synthetic oligonucleotide
aucuuuauuaaauucuccuuccacugg

SEQ ID NO: 2658 - RNA, 27 nt, Artificial Sequence
  Description of Artificial Sequence: Synthetic oligonucleotide
acuaucuuuauuaaauucuccuuccac

SEQ ID NO: 2659 - RNA, 27 nt, Artificial Sequence
  Description of Artificial Sequence: Synthetic oligonucleotide
gcacuaucuuuauuaaauucuccuucc

SEQ ID NO: 2660 - RNA, 27 nt, Artificial Sequence
  Description of Artificial Sequence: Synthetic oligonucleotide
agcacuaucuuuauuaaauucuccuuc

SEQ ID NO: 2661 - RNA, 27 nt, Artificial Sequence
  Description of Artificial Sequence: Synthetic oligonucleotide
uuucagcacuaucuuuauuaaauucuc

SEQ ID NO: 2662 - RNA, 27 nt, Artificial Sequence
  Description of Artificial Sequence: Synthetic oligonucleotide
guccuaguuauagauuaccuaaggaau

SEQ ID NO: 2663 - RNA, 27 nt, Artificial Sequence
  Description of Artificial Sequence: Synthetic oligonucleotide
aguccuaguuauagauuaccuaaggaa

SEQ ID NO: 2664 - RNA, 27 nt, Artificial Sequence
  Description of Artificial Sequence: Synthetic oligonucleotide
uaaaacaauggaauguauuacuguuac

SEQ ID NO: 2665 - RNA, 27 nt, Artificial Sequence
  Description of Artificial Sequence: Synthetic oligonucleotide
acuaaaacaauggaauguauuacuguu

SEQ ID NO: 2666 - RNA, 27 nt, Artificial Sequence
  Description of Artificial Sequence: Synthetic oligonucleotide
uacuaaaacaauggaauguauuacugu

SEQ ID NO: 2667 - RNA, 27 nt, Artificial Sequence
  Description of Artificial Sequence: Synthetic oligonucleotide
uuacuaaaacaauggaauguauuacug

SEQ ID NO: 2668 - RNA, 27 nt, Artificial Sequence
  Description of Artificial Sequence: Synthetic oligonucleotide
agauuucugguuacuaaaacaauggaa

SEQ ID NO: 2669 - RNA, 27 nt, Artificial Sequence
  Description of Artificial Sequence: Synthetic oligonucleotide
uuuucauugcaugaagauuucugguua

SEQ ID NO: 2670 - RNA, 27 nt, Artificial Sequence
  Description of Artificial Sequence: Synthetic oligonucleotide
auuaaaguauuuuucauugcaugaaga

SEQ ID NO: 2671 - RNA, 27 nt, Artificial Sequence
  Description of Artificial Sequence: Synthetic oligonucleotide
uucaugaauuaaaguauuuuucauugc

SEQ ID NO: 2672 - RNA, 27 nt, Artificial Sequence
  Description of Artificial Sequence: Synthetic oligonucleotide
gcuucaugaauuaaaguauuuuucauu

SEQ ID NO: 2673 - RNA, 27 nt, Artificial Sequence
  Description of Artificial Sequence: Synthetic oligonucleotide
agcuucaugaauuaaaguauuuuucau

SEQ ID NO: 2674 - RNA, 27 nt, Artificial Sequence
  Description of Artificial Sequence: Synthetic oligonucleotide
aaaaaaaaaaaguaagcuucaugaauu

SEQ ID NO: 2675 - RNA, 27 nt, Artificial Sequence
  Description of Artificial Sequence: Synthetic oligonucleotide
accaaaaaaaaaaaguaagcuucauga

SEQ ID NO: 2676 - RNA, 27 nt, Artificial Sequence
  Description of Artificial Sequence: Synthetic oligonucleotide
ugacaccaaaaaaaaaaaguaagcuuc

SEQ ID NO: 2677 - RNA, 27 nt, Artificial Sequence
  Description of Artificial Sequence: Synthetic oligonucleotide
acucugacaccaaaaaaaaaaaguaag

SEQ ID NO: 2678 - RNA, 27 nt, Artificial Sequence
  Description of Artificial Sequence: Synthetic oligonucleotide
gacucugacaccaaaaaaaaaaaguaa

SEQ ID NO: 2679 - RNA, 27 nt, Artificial Sequence
  Description of Artificial Sequence: Synthetic oligonucleotide
ucuccuaaaaauacaaaaauuaguuga

SEQ ID NO: 2680 - RNA, 27 nt, Artificial Sequence
  Description of Artificial Sequence: Synthetic oligonucleotide
gucucuccuaaaaauacaaaaauuagu

SEQ ID NO: 2681 - RNA, 27 nt, Artificial Sequence
  Description of Artificial Sequence: Synthetic oligonucleotide
aauaaauauuugcugaauaaaugaguu

SEQ ID NO: 2682 - RNA, 27 nt, Artificial Sequence
  Description of Artificial Sequence: Synthetic oligonucleotide
ucaauaaauauuugcugaauaaaugag

SEQ ID NO: 2683 - RNA, 27 nt, Artificial Sequence
  Description of Artificial Sequence: Synthetic oligonucleotide
acucaauaaauauuugcugaauaaaug

SEQ ID NO: 2684 - RNA, 27 nt, Artificial Sequence
  Description of Artificial Sequence: Synthetic oligonucleotide
accccuucuuugcaaaacuaaaauacg

SEQ ID NO: 2685 - RNA, 27 nt, Artificial Sequence
  Description of Artificial Sequence: Synthetic oligonucleotide
gaaucguagcaaaacaauuauagagcu

SEQ ID NO: 2686 - RNA, 27 nt, Artificial Sequence
  Description of Artificial Sequence: Synthetic oligonucleotide
acaaugaagugauuuacauaaaguagc

SEQ ID NO: 2687 - RNA, 27 nt, Artificial Sequence
  Description of Artificial Sequence: Synthetic oligonucleotide
aacaaugaagugauuuacauaaaguag

SEQ ID NO: 2688 - RNA, 27 nt, Artificial Sequence
  Description of Artificial Sequence: Synthetic oligonucleotide
aaacaaugaagugauuuacauaaagua

SEQ ID NO: 2689 - RNA, 27 nt, Artificial Sequence
  Description of Artificial Sequence: Synthetic oligonucleotide
aaaacaaugaagugauuuacauaaagu

SEQ ID NO: 2690 - RNA, 27 nt, Artificial Sequence
  Description of Artificial Sequence: Synthetic oligonucleotide
uaaaacaaugaagugauuuacauaaag

SEQ ID NO: 2691 - RNA, 27 nt, Artificial Sequence
  Description of Artificial Sequence: Synthetic oligonucleotide
uuaaaacaaugaagugauuuacauaaa

SEQ ID NO: 2692 - RNA, 27 nt, Artificial Sequence
  Description of Artificial Sequence: Synthetic oligonucleotide
uuuaaaacaaugaagugauuuacauaa

SEQ ID NO: 2693 - RNA, 27 nt, Artificial Sequence
  Description of Artificial Sequence: Synthetic oligonucleotide
aucaaguuuauuccuuuaaaacaauga

SEQ ID NO: 2694 - RNA, 27 nt, Artificial Sequence
  Description of Artificial Sequence: Synthetic oligonucleotide
aaucaaguuuauuccuuuaaaacaaug

SEQ ID NO: 2695 - RNA, 27 nt, Artificial Sequence
  Description of Artificial Sequence: Synthetic oligonucleotide
uauaaucaaguuuauuccuuuaaaaca

SEQ ID NO: 2696 - RNA, 27 nt, Artificial Sequence
  Description of Artificial Sequence: Synthetic oligonucleotide
auauaaucaaguuuauuccuuuaaaac

SEQ ID NO: 2697 - RNA, 27 nt, Artificial Sequence
  Description of Artificial Sequence: Synthetic oligonucleotide
aauauaaucaaguuuauuccuuuaaaa

SEQ ID NO: 2698 - RNA, 27 nt, Artificial Sequence
  Description of Artificial Sequence: Synthetic oligonucleotide
acaauauaaucaaguuuauuccuuuaa

SEQ ID NO: 2699 - RNA, 27 nt, Artificial Sequence
  Description of Artificial Sequence: Synthetic oligonucleotide
aacaauauaaucaaguuuauuccuuua

SEQ ID NO: 2700 - RNA, 27 nt, Artificial Sequence
  Description of Artificial Sequence: Synthetic oligonucleotide
aaacaauauaaucaaguuuauuccuuu

SEQ ID NO: 2701 - RNA, 27 nt, Artificial Sequence
  Description of Artificial Sequence: Synthetic oligonucleotide
aaaacaauauaaucaaguuuauuccuu

SEQ ID NO: 2702 - RNA, 27 nt, Artificial Sequence
  Description of Artificial Sequence: Synthetic oligonucleotide
aaaaacaauauaaucaaguuuauuccu

SEQ ID NO: 2703 - RNA, 27 nt, Artificial Sequence
  Description of Artificial Sequence: Synthetic oligonucleotide
aauaaaaaaacaauauaaucaaguuua

SEQ ID NO: 2704 - RNA, 27 nt, Artificial Sequence
  Description of Artificial Sequence: Synthetic oligonucleotide
aaauaaaaaaacaauauaaucaaguuu

SEQ ID NO: 2705 - RNA, 27 nt, Artificial Sequence
  Description of Artificial Sequence: Synthetic oligonucleotide
gccaaauaaaaaaacaauauaaucaag

SEQ ID NO: 2706 - RNA, 27 nt, Artificial Sequence
  Description of Artificial Sequence: Synthetic oligonucleotide
guuaugccaaauaaaaaaacaauauaa

SEQ ID NO: 2707 - RNA, 27 nt, Artificial Sequence
  Description of Artificial Sequence: Synthetic oligonucleotide
aguuaugccaaauaaaaaaacaauaua

SEQ ID NO: 2708 - RNA, 27 nt, Artificial Sequence
  Description of Artificial Sequence: Synthetic oligonucleotide
ucacaguuaugccaaauaaaaaaacaa

SEQ ID NO: 2709 - RNA, 27 nt, Artificial Sequence
  Description of Artificial Sequence: Synthetic oligonucleotide
aucacaguuaugccaaauaaaaaaaca

SEQ ID NO: 2710 - RNA, 27 nt, Artificial Sequence
  Description of Artificial Sequence: Synthetic oligonucleotide
uguccuaaaagaaucacaguuaugcca

SEQ ID NO: 2711 - RNA, 27 nt, Artificial Sequence
  Description of Artificial Sequence: Synthetic oligonucleotide
guaauuguccuaaaagaaucacaguua

SEQ ID NO: 2712 - RNA, 27 nt, Artificial Sequence
  Description of Artificial Sequence: Synthetic oligonucleotide
aguaauuguccuaaaagaaucacaguu

SEQ ID NO: 2713 - RNA, 27 nt, Artificial Sequence
  Description of Artificial Sequence: Synthetic oligonucleotide
ucaauaugaauaucugacauacaccuu

SEQ ID NO: 2714 - RNA, 27 nt, Artificial Sequence
  Description of Artificial Sequence: Synthetic oligonucleotide
gucaauaugaauaucugacauacaccu

SEQ ID NO: 2715 - RNA, 27 nt, Artificial Sequence
  Description of Artificial Sequence: Synthetic oligonucleotide
agaaaacuggaauauuacacauuuggg

SEQ ID NO: 2716 - RNA, 27 nt, Artificial Sequence
  Description of Artificial Sequence: Synthetic oligonucleotide
uuuaaguauauuuuaauuacuuaugca

SEQ ID NO: 2717 - RNA, 27 nt, Artificial Sequence
  Description of Artificial Sequence: Synthetic oligonucleotide
uuuuaaguauauuuuaauuacuuaugc

SEQ ID NO: 2718 - RNA, 27 nt, Artificial Sequence
  Description of Artificial Sequence: Synthetic oligonucleotide
uuuuuaaguauauuuuaauuacuuaug

SEQ ID NO: 2719 - RNA, 27 nt, Artificial Sequence
  Description of Artificial Sequence: Synthetic oligonucleotide
auuuuuaaguauauuuuaauuacuuau

SEQ ID NO: 2720 - RNA, 27 nt, Artificial Sequence
  Description of Artificial Sequence: Synthetic oligonucleotide
aauuuuuaaguauauuuuaauuacuua

SEQ ID NO: 2721 - RNA, 27 nt, Artificial Sequence
  Description of Artificial Sequence: Synthetic oligonucleotide
uaauuuuuaaguauauuuuaauuacuu

SEQ ID NO: 2722 - RNA, 27 nt, Artificial Sequence
  Description of Artificial Sequence: Synthetic oligonucleotide
uuaauuuuuaaguauauuuuaauuacu

SEQ ID NO: 2723 - RNA, 27 nt, Artificial Sequence
  Description of Artificial Sequence: Synthetic oligonucleotide
auuaauuuuuaaguauauuuuaauuac

SEQ ID NO: 2724 - RNA, 27 nt, Artificial Sequence
  Description of Artificial Sequence: Synthetic oligonucleotide
uauuaauuuuuaaguauauuuuaauua

SEQ ID NO: 2725 - RNA, 27 nt, Artificial Sequence
  Description of Artificial Sequence: Synthetic oligonucleotide
acuauuaauuuuuaaguauauuuuaau

SEQ ID NO: 2726 - RNA, 27 nt, Artificial Sequence
  Description of Artificial Sequence: Synthetic oligonucleotide
aacuauuaauuuuuaaguauauuuuaa

SEQ ID NO: 2727 - RNA, 27 nt, Artificial Sequence
  Description of Artificial Sequence: Synthetic oligonucleotide
aaacuauuaauuuuuaaguauauuuua

SEQ ID NO: 2728 - RNA, 27 nt, Artificial Sequence
  Description of Artificial Sequence: Synthetic oligonucleotide
aaaacuauuaauuuuuaaguauauuuu

SEQ ID NO: 2729 - RNA, 27 nt, Artificial Sequence
  Description of Artificial Sequence: Synthetic oligonucleotide
agauaaaacuauuaauuuuuaaguaua

SEQ ID NO: 2730 - RNA, 27 nt, Artificial Sequence
  Description of Artificial Sequence: Synthetic oligonucleotide
acccagauaaaacuauuaauuuuuaag

SEQ ID NO: 2731 - RNA, 27 nt, Artificial Sequence
  Description of Artificial Sequence: Synthetic oligonucleotide
uacccagauaaaacuauuaauuuuuaa

SEQ ID NO: 2732 - RNA, 27 nt, Artificial Sequence
  Description of Artificial Sequence: Synthetic oligonucleotide
guacccagauaaaacuauuaauuuuua

SEQ ID NO: 2733 - RNA, 27 nt, Artificial Sequence
  Description of Artificial Sequence: Synthetic oligonucleotide
ggcaccuguuuauuuguacccagauaa

SEQ ID NO: 2734 - RNA, 27 nt, Artificial Sequence
  Description of Artificial Sequence: Synthetic oligonucleotide
auuuuuacauagaaguuuccuugucug

SEQ ID NO: 2735 - RNA, 27 nt, Artificial Sequence
  Description of Artificial Sequence: Synthetic oligonucleotide
gauuuuuacauagaaguuuccuugucu

SEQ ID NO: 2736 - RNA, 27 nt, Artificial Sequence
  Description of Artificial Sequence: Synthetic oligonucleotide
ugauuuuuacauagaaguuuccuuguc

SEQ ID NO: 2737 - RNA, 27 nt, Artificial Sequence
  Description of Artificial Sequence: Synthetic oligonucleotide
aaaucauagugauuuuuacauagaagu

SEQ ID NO: 2738 - RNA, 27 nt, Artificial Sequence
  Description of Artificial Sequence: Synthetic oligonucleotide
gaaaucauagugauuuuuacauagaag

SEQ ID NO: 2739 - RNA, 27 nt, Artificial Sequence
  Description of Artificial Sequence: Synthetic oligonucleotide
agaaaucauagugauuuuuacauagaa

SEQ ID NO: 2740 - RNA, 27 nt, Artificial Sequence
  Description of Artificial Sequence: Synthetic oligonucleotide
auucagaaaucauagugauuuuuacau

SEQ ID NO: 2741 - RNA, 27 nt, Artificial Sequence
  Description of Artificial Sequence: Synthetic oligonucleotide
aauucagaaaucauagugauuuuuaca

SEQ ID NO: 2742 - RNA, 27 nt, Artificial Sequence
  Description of Artificial Sequence: Synthetic oligonucleotide
ucacauagcaauucagaaaucauagug

SEQ ID NO: 2743 - RNA, 27 nt, Artificial Sequence
  Description of Artificial Sequence: Synthetic oligonucleotide
uucacauagcaauucagaaaucauagu

SEQ ID NO: 2744 - RNA, 27 nt, Artificial Sequence
  Description of Artificial Sequence: Synthetic oligonucleotide
uuccaaagaucuguaguuucacauagc

SEQ ID NO: 2745 - RNA, 27 nt, Artificial Sequence
  Description of Artificial Sequence: Synthetic oligonucleotide
guuccaaagaucuguaguuucacauag

SEQ ID NO: 2746 - RNA, 27 nt, Artificial Sequence
  Description of Artificial Sequence: Synthetic oligonucleotide
gguacuguguaagucuuaacacccuac

SEQ ID NO: 2747 - RNA, 27 nt, Artificial Sequence
  Description of Artificial Sequence: Synthetic oligonucleotide
acaucaaaaauucaagaggccuaaaua

SEQ ID NO: 2748 - RNA, 27 nt, Artificial Sequence
  Description of Artificial Sequence: Synthetic oligonucleotide
gcccaucuacaucaaaaauucaagagg

SEQ ID NO: 2749 - RNA, 27 nt, Artificial Sequence
  Description of Artificial Sequence: Synthetic oligonucleotide
ugcccaucuacaucaaaaauucaagag

SEQ ID NO: 2750 - RNA, 27 nt, Artificial Sequence
  Description of Artificial Sequence: Synthetic oligonucleotide
acuaccuuaaaaaaaugcccaucuaca

SEQ ID NO: 2751 - RNA, 27 nt, Artificial Sequence
  Description of Artificial Sequence: Synthetic oligonucleotide
uuaaccacuaccuuaaaaaaaugccca

SEQ ID NO: 2752 - RNA, 27 nt, Artificial Sequence
  Description of Artificial Sequence: Synthetic oligonucleotide
acauaaagguaauuaaccacuaccuua

SEQ ID NO: 2753 - RNA, 27 nt, Artificial Sequence
  Description of Artificial Sequence: Synthetic oligonucleotide
ucacauaaagguaauuaaccacuaccu

SEQ ID NO: 2754 - RNA, 27 nt, Artificial Sequence
  Description of Artificial Sequence: Synthetic oligonucleotide
uucacauaaagguaauuaaccacuacc

SEQ ID NO: 2755 - RNA, 27 nt, Artificial Sequence
  Description of Artificial Sequence: Synthetic oligonucleotide
guucacauaaagguaauuaaccacuac

SEQ ID NO: 2756 - RNA, 27 nt, Artificial Sequence
  Description of Artificial Sequence: Synthetic oligonucleotide
aguucacauaaagguaauuaaccacua

SEQ ID NO: 2757 - RNA, 27 nt, Artificial Sequence
  Description of Artificial Sequence: Synthetic oligonucleotide
aaccauucaaaguucacauaaagguaa

SEQ ID NO: 2758 - RNA, 27 nt, Artificial Sequence
  Description of Artificial Sequence: Synthetic oligonucleotide
uguuaaaccauucaaaguucacauaaa

SEQ ID NO: 2759 - RNA, 27 nt, Artificial Sequence
  Description of Artificial Sequence: Synthetic oligonucleotide
aucuuuuguuaaaccauucaaaguuca

SEQ ID NO: 2760 - RNA, 27 nt, Artificial Sequence
  Description of Artificial Sequence: Synthetic oligonucleotide
acaaaucuuuuguuaaaccauucaaag

SEQ ID NO: 2761 - RNA, 27 nt, Artificial Sequence
  Description of Artificial Sequence: Synthetic oligonucleotide
aacaaaucuuuuguuaaaccauucaaa

SEQ ID NO: 2762 - RNA, 27 nt, Artificial Sequence
  Description of Artificial Sequence: Synthetic oligonucleotide
aaacaaaucuuuuguuaaaccauucaa

SEQ ID NO: 2763 - RNA, 27 nt, Artificial Sequence
  Description of Artificial Sequence: Synthetic oligonucleotide
aaaacaaaucuuuuguuaaaccauuca

SEQ ID NO: 2764 - RNA, 27 nt, Artificial Sequence
  Description of Artificial Sequence: Synthetic oligonucleotide
aaaaacaaaucuuuuguuaaaccauuc

SEQ ID NO: 2765 - RNA, 27 nt, Artificial Sequence
  Description of Artificial Sequence: Synthetic oligonucleotide
acaaaaacaaaucuuuuguuaaaccau

SEQ ID NO: 2766 - RNA, 27 nt, Artificial Sequence
  Description of Artificial Sequence: Synthetic oligonucleotide
uacaaaaacaaaucuuuuguuaaacca

SEQ ID NO: 2767 - RNA, 27 nt, Artificial Sequence
  Description of Artificial Sequence: Synthetic oligonucleotide
ucucuacaaaaacaaaucuuuuguuaa

SEQ ID NO: 2768 - RNA, 27 nt, Artificial Sequence
  Description of Artificial Sequence: Synthetic oligonucleotide
aucucuacaaaaacaaaucuuuuguua

SEQ ID NO: 2769 - RNA, 27 nt, Artificial Sequence
  Description of Artificial Sequence: Synthetic oligonucleotide
aaucucuacaaaaacaaaucuuuuguu

SEQ ID NO: 2770 - RNA, 27 nt, Artificial Sequence
  Description of Artificial Sequence: Synthetic oligonucleotide
aaaaucucuacaaaaacaaaucuuuug

SEQ ID NO: 2771 - RNA, 27 nt, Artificial Sequence
  Description of Artificial Sequence: Synthetic oligonucleotide
uaaaaucucuacaaaaacaaaucuuuu

SEQ ID NO: 2772 - RNA, 27 nt, Artificial Sequence
  Description of Artificial Sequence: Synthetic oligonucleotide
uuaaaaucucuacaaaaacaaaucuuu

SEQ ID NO: 2773 - RNA, 27 nt, Artificial Sequence
  Description of Artificial Sequence: Synthetic oligonucleotide
uuuaaaaucucuacaaaaacaaaucuu

SEQ ID NO: 2774 - RNA, 27 nt, Artificial Sequence
  Description of Artificial Sequence: Synthetic oligonucleotide
ucccccuuuaaaaucucuacaaaaaca

SEQ ID NO: 2775 - RNA, 27 nt, Artificial Sequence
  Description of Artificial Sequence: Synthetic oligonucleotide
auuuauuucuagaauucucccccuuua

SEQ ID NO: 2776 - RNA, 27 nt, Artificial Sequence
  Description of Artificial Sequence: Synthetic oligonucleotide
acauuuauuucuagaauucucccccuu

SEQ ID NO: 2777 - RNA, 27 nt, Artificial Sequence
  Description of Artificial Sequence: Synthetic oligonucleotide
aacauuuauuucuagaauucucccccu

SEQ ID NO: 2778 - RNA, 27 nt, Artificial Sequence
  Description of Artificial Sequence: Synthetic oligonucleotide
uaacauuuauuucuagaauucuccccc

SEQ ID NO: 2779 - RNA, 27 nt, Artificial Sequence
  Description of Artificial Sequence: Synthetic oligonucleotide
guaacauuuauuucuagaauucucccc

SEQ ID NO: 2780 - RNA, 27 nt, Artificial Sequence
  Description of Artificial Sequence: Synthetic oligonucleotide
gguaacauuuauuucuagaauucuccc

SEQ ID NO: 2781 - RNA, 27 nt, Artificial Sequence
  Description of Artificial Sequence: Synthetic oligonucleotide
aauuagguaacauuuauuucuagaauu

SEQ ID NO: 2782 - RNA, 27 nt, Artificial Sequence
  Description of Artificial Sequence: Synthetic oligonucleotide
uaauuagguaacauuuauuucuagaau

SEQ ID NO: 2783 - RNA, 27 nt, Artificial Sequence
  Description of Artificial Sequence: Synthetic oligonucleotide
auaauuagguaacauuuauuucuagaa

SEQ ID NO: 2784 - RNA, 27 nt, Artificial Sequence
  Description of Artificial Sequence: Synthetic oligonucleotide
aauaauuagguaacauuuauuucuaga

SEQ ID NO: 2785 - RNA, 27 nt, Artificial Sequence
  Description of Artificial Sequence: Synthetic oligonucleotide
uaauaauuagguaacauuuauuucuag

SEQ ID NO: 2786 - RNA, 27 nt, Artificial Sequence
  Description of Artificial Sequence: Synthetic oligonucleotide
uguaauaauuagguaacauuuauuucu

SEQ ID NO: 2787 - RNA, 27 nt, Artificial Sequence
  Description of Artificial Sequence: Synthetic oligonucleotide
gucuuuaaggcuguaauaauuagguaa

SEQ ID NO: 2788 - RNA, 27 nt, Artificial Sequence
  Description of Artificial Sequence: Synthetic oligonucleotide
ugucuuuaaggcuguaauaauuaggua

SEQ ID NO: 2789 - RNA, 27 nt, Artificial Sequence
  Description of Artificial Sequence: Synthetic oligonucleotide
ucaacaaggauuuuugucuuuaaggcu

SEQ ID NO: 2790 - RNA, 27 nt, Artificial Sequence
  Description of Artificial Sequence: Synthetic oligonucleotide
acuucaacaaggauuuuugucuuuaag

SEQ ID NO: 2791 - RNA, 27 nt, Artificial Sequence
  Description of Artificial Sequence: Synthetic oligonucleotide
uuuuuuaaaaaaacuucaacaaggauu

SEQ ID NO: 2792 - RNA, 27 nt, Artificial Sequence
  Description of Artificial Sequence: Synthetic oligonucleotide
uuuuuuuaaaaaaacuucaacaaggau

SEQ ID NO: 2793 - RNA, 27 nt, Artificial Sequence
  Description of Artificial Sequence: Synthetic oligonucleotide
gcuuuuuuuaaaaaaacuucaacaagg

SEQ ID NO: 2794 - RNA, 27 nt, Artificial Sequence
  Description of Artificial Sequence: Synthetic oligonucleotide
agcuuuuuuuaaaaaaacuucaacaag

SEQ ID NO: 2795 - RNA, 27 nt, Artificial Sequence
  Description of Artificial Sequence: Synthetic oligonucleotide
auuuagcuuuuuuuaaaaaaacuucaa

SEQ ID NO: 2796 - RNA, 27 nt, Artificial Sequence
  Description of Artificial Sequence: Synthetic oligonucleotide
aauuuagcuuuuuuuaaaaaaacuuca

SEQ ID NO: 2797 - RNA, 27 nt, Artificial Sequence
  Description of Artificial Sequence: Synthetic oligonucleotide
uaauuuagcuuuuuuuaaaaaaacuuc

SEQ ID NO: 2798 - RNA, 27 nt, Artificial Sequence
  Description of Artificial Sequence: Synthetic oligonucleotide
guaauuuagcuuuuuuuaaaaaaacuu

SEQ ID NO: 2799 - RNA, 27 nt, Artificial Sequence
  Description of Artificial Sequence: Synthetic oligonucleotide
uguaauuuagcuuuuuuuaaaaaaacu

SEQ ID NO: 2800 - RNA, 27 nt, Artificial Sequence
  Description of Artificial Sequence: Synthetic oligonucleotide
ucuauguaauuuagcuuuuuuuaaaaa

SEQ ID NO: 2801 - RNA, 27 nt, Artificial Sequence
  Description of Artificial Sequence: Synthetic oligonucleotide
agucuauguaauuuagcuuuuuuuaaa

SEQ ID NO: 2802 - RNA, 27 nt, Artificial Sequence
  Description of Artificial Sequence: Synthetic oligonucleotide
uccacaaacauguuaaugccuaagucu

SEQ ID NO: 2803 - RNA, 27 nt, Artificial Sequence
  Description of Artificial Sequence: Synthetic oligonucleotide
uuccacaaacauguuaaugccuaaguc

SEQ ID NO: 2804 - RNA, 27 nt, Artificial Sequence
  Description of Artificial Sequence: Synthetic oligonucleotide
ucaaaugauacaauauacgucugcuau

SEQ ID NO: 2805 - RNA, 27 nt, Artificial Sequence
  Description of Artificial Sequence: Synthetic oligonucleotide
ucacucaaaugauacaauauacgucug

SEQ ID NO: 2806 - RNA, 27 nt, Artificial Sequence
  Description of Artificial Sequence: Synthetic oligonucleotide
auucacucaaaugauacaauauacguc

SEQ ID NO: 2807 - RNA, 27 nt, Artificial Sequence
  Description of Artificial Sequence: Synthetic oligonucleotide
aacauucacucaaaugauacaauauac

SEQ ID NO: 2808 - RNA, 27 nt, Artificial Sequence
  Description of Artificial Sequence: Synthetic oligonucleotide
gaacauucacucaaaugauacaauaua

SEQ ID NO: 2809 - RNA, 27 nt, Artificial Sequence
  Description of Artificial Sequence: Synthetic oligonucleotide
ggaacauucacucaaaugauacaauau

SEQ ID NO: 2810 - RNA, 27 nt, Artificial Sequence
  Description of Artificial Sequence: Synthetic oligonucleotide
uaaaaguuagguucuaaauuccuaugc

SEQ ID NO: 2811 - RNA, 27 nt, Artificial Sequence
  Description of Artificial Sequence: Synthetic oligonucleotide
auaaaaguuagguucuaaauuccuaug

SEQ ID NO: 2812 - RNA, 27 nt, Artificial Sequence
  Description of Artificial Sequence: Synthetic oligonucleotide
accuauaaaaguuagguucuaaauucc

SEQ ID NO: 2813 - RNA, 27 nt, Artificial Sequence
  Description of Artificial Sequence: Synthetic oligonucleotide
aaccuauaaaaguuagguucuaaauuc

SEQ ID NO: 2814 - RNA, 27 nt, Artificial Sequence
  Description of Artificial Sequence: Synthetic oligonucleotide
uaaccuauaaaaguuagguucuaaauu

SEQ ID NO: 2815 - RNA, 27 nt, Artificial Sequence
  Description of Artificial Sequence: Synthetic oligonucleotide
auaaccuauaaaaguuagguucuaaau

SEQ ID NO: 2816 - RNA, 27 nt, Artificial Sequence
  Description of Artificial Sequence: Synthetic oligonucleotide
acaacaguuuugauaaccuauaaaagu

SEQ ID NO: 2817 - RNA, 27 nt, Artificial Sequence
  Description of Artificial Sequence: Synthetic oligonucleotide
ugacaacaguuuugauaaccuauaaaa

SEQ ID NO: 2818 - RNA, 27 nt, Artificial Sequence
  Description of Artificial Sequence: Synthetic oligonucleotide
ucuauguauauauuaggacaaaauugu

SEQ ID NO: 2819 - RNA, 27 nt, Artificial Sequence
  Description of Artificial Sequence: Synthetic oligonucleotide
uucuauguauauauuaggacaaaauug

SEQ ID NO: 2820 - RNA, 27 nt, Artificial Sequence
  Description of Artificial Sequence: Synthetic oligonucleotide
uuucuauguauauauuaggacaaaauu

SEQ ID NO: 2821 - RNA, 27 nt, Artificial Sequence
  Description of Artificial Sequence: Synthetic oligonucleotide
acaaaguuucuauguauauauuaggac

SEQ ID NO: 2822 - RNA, 27 nt, Artificial Sequence
  Description of Artificial Sequence: Synthetic oligonucleotide
gccccacaaaguuucuauguauauauu

SEQ ID NO: 2823 - RNA, 27 nt, Artificial Sequence
  Description of Artificial Sequence: Synthetic oligonucleotide
ggaauacaaaugagaugaacuugugca

SEQ ID NO: 2824 - RNA, 27 nt, Artificial Sequence
  Description of Artificial Sequence: Synthetic oligonucleotide
aaaaaaucaauggaauacaaaugagau

SEQ ID NO: 2825 - RNA, 27 nt, Artificial Sequence
  Description of Artificial Sequence: Synthetic oligonucleotide
aaaaaaaucaauggaauacaaaugaga

SEQ ID NO: 2826 - RNA, 27 nt, Artificial Sequence
  Description of Artificial Sequence: Synthetic oligonucleotide
aaaaaaaaucaauggaauacaaaugag

SEQ ID NO: 2827 - RNA, 27 nt, Artificial Sequence
  Description of Artificial Sequence: Synthetic oligonucleotide
aaaaaaaaaucaauggaauacaaauga

SEQ ID NO: 2828 - RNA, 27 nt, Artificial Sequence
  Description of Artificial Sequence: Synthetic oligonucleotide
aaaaaaaaaaucaauggaauacaaaug

SEQ ID NO: 2829 - RNA, 27 nt, Artificial Sequence
  Description of Artificial Sequence: Synthetic oligonucleotide
gaaaaaaaaaaucaauggaauacaaau

SEQ ID NO: 2830 - RNA, 27 nt, Artificial Sequence
  Description of Artificial Sequence: Synthetic oligonucleotide
agaaaaaaaaaaucaauggaauacaaa

SEQ ID NO: 2831 - RNA, 27 nt, Artificial Sequence
  Description of Artificial Sequence: Synthetic oligonucleotide
guuuagaagaaaaaaaaaaucaaugga

SEQ ID NO: 2832 - RNA, 27 nt, Artificial Sequence
  Description of Artificial Sequence: Synthetic oligonucleotide
uguuuagaagaaaaaaaaaaucaaugg

SEQ ID NO: 2833 - RNA, 27 nt, Artificial Sequence
  Description of Artificial Sequence: Synthetic oligonucleotide
aaaauguuuagaagaaaaaaaaaauca

SEQ ID NO: 2834 - RNA, 27 nt, Artificial Sequence
  Description of Artificial Sequence: Synthetic oligonucleotide
aaaaauguuuagaagaaaaaaaaaauc

SEQ ID NO: 2835 - RNA, 27 nt, Artificial Sequence
  Description of Artificial Sequence: Synthetic oligonucleotide
aaaaaauguuuagaagaaaaaaaaaau

SEQ ID NO: 2836 - RNA, 27 nt, Artificial Sequence
  Description of Artificial Sequence: Synthetic oligonucleotide
gaaaaaauguuuagaagaaaaaaaaaa

SEQ ID NO: 2837 - RNA, 27 nt, Artificial Sequence
  Description of Artificial Sequence: Synthetic oligonucleotide
agaaaaaauguuuagaagaaaaaaaaa

SEQ ID NO: 2838 - RNA, 27 nt, Artificial Sequence
  Description of Artificial Sequence: Synthetic oligonucleotide
auauacuguuugaagaaaaaauguuua

SEQ ID NO: 2839 - RNA, 27 nt, Artificial Sequence
  Description of Artificial Sequence: Synthetic oligonucleotide
uauauacuguuugaagaaaaaauguuu

SEQ ID NO: 2840 - RNA, 27 nt, Artificial Sequence
  Description of Artificial Sequence: Synthetic oligonucleotide
uuauauacuguuugaagaaaaaauguu

SEQ ID NO: 2841 - RNA, 27 nt, Artificial Sequence
  Description of Artificial Sequence: Synthetic oligonucleotide
guuauauacuguuugaagaaaaaaugu

SEQ ID NO: 2842 - RNA, 27 nt, Artificial Sequence
  Description of Artificial Sequence: Synthetic oligonucleotide
aguuauauacuguuugaagaaaaaaug

SEQ ID NO: 2843 - RNA, 27 nt, Artificial Sequence
  Description of Artificial Sequence: Synthetic oligonucleotide
uaaaaaaaguuauauacuguuugaaga

SEQ ID NO: 2844 - RNA, 27 nt, Artificial Sequence
  Description of Artificial Sequence: Synthetic oligonucleotide
uccccuaaaaaaaguuauauacuguuu

SEQ ID NO: 2845 - RNA, 27 nt, Artificial Sequence
  Description of Artificial Sequence: Synthetic oligonucleotide
auccccuaaaaaaaguuauauacuguu

SEQ ID NO: 2846 - RNA, 27 nt, Artificial Sequence
  Description of Artificial Sequence: Synthetic oligonucleotide
aauccccuaaaaaaaguuauauacugu

SEQ ID NO: 2847 - RNA, 27 nt, Artificial Sequence
  Description of Artificial Sequence: Synthetic oligonucleotide
aaauccccuaaaaaaaguuauauacug

SEQ ID NO: 2848 - RNA, 27 nt, Artificial Sequence
  Description of Artificial Sequence: Synthetic oligonucleotide
aaaaaaaaauccccuaaaaaaaguuau

SEQ ID NO: 2849 - RNA, 27 nt, Artificial Sequence
  Description of Artificial Sequence: Synthetic oligonucleotide
uaaaaaaaaauccccuaaaaaaaguua

SEQ ID NO: 2850 - RNA, 27 nt, Artificial Sequence
  Description of Artificial Sequence: Synthetic oligonucleotide
uuuuugcugucuaaaaaaaaauccccu

SEQ ID NO: 2851 - RNA, 27 nt, Artificial Sequence
  Description of Artificial Sequence: Synthetic oligonucleotide
guuuuugcugucuaaaaaaaaaucccc

SEQ ID NO: 2852 - RNA, 27 nt, Artificial Sequence
  Description of Artificial Sequence: Synthetic oligonucleotide
aguuuuugcugucuaaaaaaaaauccc

SEQ ID NO: 2853 - RNA, 27 nt, Artificial Sequence
  Description of Artificial Sequence: Synthetic oligonucleotide
acuuuuugacaaauggaaaucuucaga

SEQ ID NO: 2854 - RNA, 27 nt, Artificial Sequence
  Description of Artificial Sequence: Synthetic oligonucleotide
uacuuuuugacaaauggaaaucuucag

SEQ ID NO: 2855 - RNA, 27 nt, Artificial Sequence
  Description of Artificial Sequence: Synthetic oligonucleotide
uuacuuuuugacaaauggaaaucuuca

SEQ ID NO: 2856 - RNA, 27 nt, Artificial Sequence
  Description of Artificial Sequence: Synthetic oligonucleotide
auuacuuuuugacaaauggaaaucuuc

SEQ ID NO: 2857 - RNA, 27 nt, Artificial Sequence
  Description of Artificial Sequence: Synthetic oligonucleotide
aaaucauuacuuuuugacaaauggaaa

SEQ ID NO: 2858 - RNA, 27 nt, Artificial Sequence
  Description of Artificial Sequence: Synthetic oligonucleotide
gaaaucauuacuuuuugacaaauggaa

SEQ ID NO: 2859 - RNA, 27 nt, Artificial Sequence
  Description of Artificial Sequence: Synthetic oligonucleotide
agaaaucauuacuuuuugacaaaugga

SEQ ID NO: 2860 - RNA, 27 nt, Artificial Sequence
  Description of Artificial Sequence: Synthetic oligonucleotide
uaucaagaaaucauuacuuuuugacaa

SEQ ID NO: 2861 - RNA, 27 nt, Artificial Sequence
  Description of Artificial Sequence: Synthetic oligonucleotide
uuaucaagaaaucauuacuuuuugaca

SEQ ID NO: 2862 - RNA, 27 nt, Artificial Sequence
  Description of Artificial Sequence: Synthetic oligonucleotide
auuaucaagaaaucauuacuuuuugac

SEQ ID NO: 2863 - RNA, 27 nt, Artificial Sequence
  Description of Artificial Sequence: Synthetic oligonucleotide
aauuaucaagaaaucauuacuuuuuga

SEQ ID NO: 2864 - RNA, 27 nt, Artificial Sequence
  Description of Artificial Sequence: Synthetic oligonucleotide
acaauuaucaagaaaucauuacuuuuu

SEQ ID NO: 2865 - RNA, 27 nt, Artificial Sequence
  Description of Artificial Sequence: Synthetic oligonucleotide
acacaauuaucaagaaaucauuacuuu

SEQ ID NO: 2866 - RNA, 27 nt, Artificial Sequence
  Description of Artificial Sequence: Synthetic oligonucleotide
uacacaauuaucaagaaaucauuacuu

SEQ ID NO: 2867 - RNA, 27 nt, Artificial Sequence
  Description of Artificial Sequence: Synthetic oligonucleotide
acuacacaauuaucaagaaaucauuac

SEQ ID NO: 2868 - RNA, 27 nt, Artificial Sequence
  Description of Artificial Sequence: Synthetic oligonucleotide
uacuacacaauuaucaagaaaucauua

SEQ ID NO: 2869 - RNA, 27 nt, Artificial Sequence
  Description of Artificial Sequence: Synthetic oligonucleotide
aacauuacuacacaauuaucaagaaau

SEQ ID NO: 2870 - RNA, 27 nt, Artificial Sequence
  Description of Artificial Sequence: Synthetic oligonucleotide
aaacauuacuacacaauuaucaagaaa

SEQ ID NO: 2871 - RNA, 27 nt, Artificial Sequence
  Description of Artificial Sequence: Synthetic oligonucleotide
aaaacauuacuacacaauuaucaagaa

SEQ ID NO: 2872 - RNA, 27 nt, Artificial Sequence
  Description of Artificial Sequence: Synthetic oligonucleotide
aaaaaacauuacuacacaauuaucaag

SEQ ID NO: 2873 - RNA, 27 nt, Artificial Sequence
  Description of Artificial Sequence: Synthetic oligonucleotide
ucuaaaaaacauuacuacacaauuauc

SEQ ID NO: 2874 - RNA, 27 nt, Artificial Sequence
  Description of Artificial Sequence: Synthetic oligonucleotide
guucuaaaaaacauuacuacacaauua

SEQ ID NO: 2875 - RNA, 27 nt, Artificial Sequence
  Description of Artificial Sequence: Synthetic oligonucleotide
gguucuaaaaaacauuacuacacaauu

SEQ ID NO: 2876 - RNA, 27 nt, Artificial Sequence
  Description of Artificial Sequence: Synthetic oligonucleotide
acuaaauauaaauucagcuuuaaggua

SEQ ID NO: 2877 - RNA, 27 nt, Artificial Sequence
  Description of Artificial Sequence: Synthetic oligonucleotide
uuacuaaauauaaauucagcuuuaagg

SEQ ID NO: 2878 - RNA, 27 nt, Artificial Sequence
  Description of Artificial Sequence: Synthetic oligonucleotide
acacagaaguuacuaaauauaaauuca

SEQ ID NO: 2879 - RNA, 27 nt, Artificial Sequence
  Description of Artificial Sequence: Synthetic oligonucleotide
aacacagaaguuacuaaauauaaauuc

SEQ ID NO: 2880 - RNA, 27 nt, Artificial Sequence
  Description of Artificial Sequence: Synthetic oligonucleotide
uaacacagaaguuacuaaauauaaauu

SEQ ID NO: 2881 - RNA, 27 nt, Artificial Sequence
  Description of Artificial Sequence: Synthetic oligonucleotide
aguauuaacacagaaguuacuaaauau

SEQ ID NO: 2882 - RNA, 27 nt, Artificial Sequence
  Description of Artificial Sequence: Synthetic oligonucleotide
uuucauuuuaugacagcuauucaguuu

SEQ ID NO: 2883 - RNA, 27 nt, Artificial Sequence
  Description of Artificial Sequence: Synthetic oligonucleotide
guuucauuuuaugacagcuauucaguu

SEQ ID NO: 2884 - RNA, 27 nt, Artificial Sequence
  Description of Artificial Sequence: Synthetic oligonucleotide
ucuuuagaaagaaaguuucauuuuaug

SEQ ID NO: 2885 - RNA, 27 nt, Artificial Sequence
  Description of Artificial Sequence: Synthetic oligonucleotide
uucuuuagaaagaaaguuucauuuuau

SEQ ID NO: 2886 - RNA, 27 nt, Artificial Sequence
  Description of Artificial Sequence: Synthetic oligonucleotide
uuucuuuagaaagaaaguuucauuuua

SEQ ID NO: 2887 - RNA, 27 nt, Artificial Sequence
  Description of Artificial Sequence: Synthetic oligonucleotide
ucuuucuuuagaaagaaaguuucauuu

SEQ ID NO: 2888 - RNA, 27 nt, Artificial Sequence
  Description of Artificial Sequence: Synthetic oligonucleotide
aguaucuuucuuuagaaagaaaguuuc

SEQ ID NO: 2889 - RNA, 27 nt, Artificial Sequence
  Description of Artificial Sequence: Synthetic oligonucleotide
ugacuauucuucaagaacucaugugag

SEQ ID NO: 2890 - RNA, 27 nt, Artificial Sequence
  Description of Artificial Sequence: Synthetic oligonucleotide
aucuaguuaugacuauucuucaagaac

SEQ ID NO: 2891 - RNA, 27 nt, Artificial Sequence
  Description of Artificial Sequence: Synthetic oligonucleotide
aaucuaguuaugacuauucuucaagaa

SEQ ID NO: 2892 - RNA, 27 nt, Artificial Sequence
  Description of Artificial Sequence: Synthetic oligonucleotide
uaaucuaguuaugacuauucuucaaga

SEQ ID NO: 2893 - RNA, 27 nt, Artificial Sequence
  Description of Artificial Sequence: Synthetic oligonucleotide
ucuuaaucuaguuaugacuauucuuca

SEQ ID NO: 2894 - RNA, 27 nt, Artificial Sequence
  Description of Artificial Sequence: Synthetic oligonucleotide
aucuuaaucuaguuaugacuauucuuc

SEQ ID NO: 2895 - RNA, 27 nt, Artificial Sequence
  Description of Artificial Sequence: Synthetic oligonucleotide
gaucuuaaucuaguuaugacuauucuu

SEQ ID NO: 2896 - RNA, 27 nt, Artificial Sequence
  Description of Artificial Sequence: Synthetic oligonucleotide
agaucuuaaucuaguuaugacuauucu

SEQ ID NO: 2897 - RNA, 27 nt, Artificial Sequence
  Description of Artificial Sequence: Synthetic oligonucleotide
acacagaucuuaaucuaguuaugacua

SEQ ID NO: 2898 - RNA, 27 nt, Artificial Sequence
  Description of Artificial Sequence: Synthetic oligonucleotide
acuaaaacacagaucuuaaucuaguua

SEQ ID NO: 2899 - RNA, 27 nt, Artificial Sequence
  Description of Artificial Sequence: Synthetic oligonucleotide
aaacuaaaacacagaucuuaaucuagu

SEQ ID NO: 2900 - RNA, 27 nt, Artificial Sequence
  Description of Artificial Sequence: Synthetic oligonucleotide
uaaacuaaaacacagaucuuaaucuag

SEQ ID NO: 2901 - RNA, 27 nt, Artificial Sequence
  Description of Artificial Sequence: Synthetic oligonucleotide
auuaaacuaaaacacagaucuuaaucu

SEQ ID NO: 2902 - RNA, 27 nt, Artificial Sequence
  Description of Artificial Sequence: Synthetic oligonucleotide
ucaaacuauuaaacuaaaacacagauc

SEQ ID NO: 2903 - RNA, 27 nt, Artificial Sequence
  Description of Artificial Sequence: Synthetic oligonucleotide
uucaaacuauuaaacuaaaacacagau

SEQ ID NO: 2904 - RNA, 27 nt, Artificial Sequence
  Description of Artificial Sequence: Synthetic oligonucleotide
acuucaaacuauuaaacuaaaacacag

SEQ ID NO: 2905 - RNA, 27 nt, Artificial Sequence
  Description of Artificial Sequence: Synthetic oligonucleotide
gcacuucaaacuauuaaacuaaaacac

SEQ ID NO: 2906 - RNA, 27 nt, Artificial Sequence
  Description of Artificial Sequence: Synthetic oligonucleotide
ggcacuucaaacuauuaaacuaaaaca

SEQ ID NO: 2907 - RNA, 27 nt, Artificial Sequence
  Description of Artificial Sequence: Synthetic oligonucleotide
uaaauuaccuaucauuaucccaaacag

SEQ ID NO: 2908 - RNA, 27 nt, Artificial Sequence
  Description of Artificial Sequence: Synthetic oligonucleotide
ucuaaauuaccuaucauuaucccaaac

SEQ ID NO: 2909 - RNA, 27 nt, Artificial Sequence
  Description of Artificial Sequence: Synthetic oligonucleotide
ucaucuaaauuaccuaucauuauccca

SEQ ID NO: 2910 - RNA, 27 nt, Artificial Sequence
  Description of Artificial Sequence: Synthetic oligonucleotide
uucaucuaaauuaccuaucauuauccc

SEQ ID NO: 2911 - RNA, 27 nt, Artificial Sequence
  Description of Artificial Sequence: Synthetic oligonucleotide
aaauucaucuaaauuaccuaucauuau

SEQ ID NO: 2912 - RNA, 27 nt, Artificial Sequence
  Description of Artificial Sequence: Synthetic oligonucleotide
uaaauucaucuaaauuaccuaucauua

SEQ ID NO: 2913 - RNA, 27 nt, Artificial Sequence
  Description of Artificial Sequence: Synthetic oligonucleotide
uccccuaaauucaucuaaauuaccuau

SEQ ID NO: 2914 - RNA, 27 nt, Artificial Sequence
  Description of Artificial Sequence: Synthetic oligonucleotide
uuuccccuaaauucaucuaaauuaccu

SEQ ID NO: 2915 - RNA, 27 nt, Artificial Sequence
  Description of Artificial Sequence: Synthetic oligonucleotide
acuuuuuuuuccccuaaauucaucuaa

SEQ ID NO: 2916 - RNA, 27 nt, Artificial Sequence
  Description of Artificial Sequence: Synthetic oligonucleotide
aacuuuuuuuuccccuaaauucaucua

SEQ ID NO: 2917 - RNA, 27 nt, Artificial Sequence
  Description of Artificial Sequence: Synthetic oligonucleotide
uaucugcagauaacuuuuuuuuccccu

SEQ ID NO: 2918 - RNA, 27 nt, Artificial Sequence
  Description of Artificial Sequence: Synthetic oligonucleotide
auaucugcagauaacuuuuuuuucccc

SEQ ID NO: 2919 - RNA, 27 nt, Artificial Sequence
  Description of Artificial Sequence: Synthetic oligonucleotide
ucaacauaucugcagauaacuuuuuuu

SEQ ID NO: 2920 - RNA, 27 nt, Artificial Sequence
  Description of Artificial Sequence: Synthetic oligonucleotide
uauuuucaacaugaaaacacaagacag

SEQ ID NO: 2921 - RNA, 27 nt, Artificial Sequence
  Description of Artificial Sequence: Synthetic oligonucleotide
guauuuucaacaugaaaacacaagaca

SEQ ID NO: 2922 - RNA, 27 nt, Artificial Sequence
  Description of Artificial Sequence: Synthetic oligonucleotide
aguauuuucaacaugaaaacacaagac

SEQ ID NO: 2923 - RNA, 27 nt, Artificial Sequence
  Description of Artificial Sequence: Synthetic oligonucleotide
aaaaugcaaaaguauuuucaacaugaa

SEQ ID NO: 2924 - RNA, 27 nt, Artificial Sequence
  Description of Artificial Sequence: Synthetic oligonucleotide
aaaaaugcaaaaguauuuucaacauga

SEQ ID NO: 2925 - RNA, 27 nt, Artificial Sequence
  Description of Artificial Sequence: Synthetic oligonucleotide
gaaaaaugcaaaaguauuuucaacaug

SEQ ID NO: 2926 - RNA, 27 nt, Artificial Sequence
  Description of Artificial Sequence: Synthetic oligonucleotide
ggaaaaaugcaaaaguauuuucaacau

SEQ ID NO: 2927 - RNA, 27 nt, Artificial Sequence
  Description of Artificial Sequence: Synthetic oligonucleotide
ggcacucaaaggaaaaaugcaaaagua

SEQ ID NO: 2928 - RNA, 27 nt, Artificial Sequence
  Description of Artificial Sequence: Synthetic oligonucleotide
aguacuaguaagaaauuggcacucaaa

SEQ ID NO: 2929 - RNA, 27 nt, Artificial Sequence
  Description of Artificial Sequence: Synthetic oligonucleotide
gaaauaguacuaguaagaaauuggcac

SEQ ID NO: 2930 - RNA, 27 nt, Artificial Sequence
  Description of Artificial Sequence: Synthetic oligonucleotide
agaaauaguacuaguaagaaauuggca

SEQ ID NO: 2931 - RNA, 27 nt, Artificial Sequence
  Description of Artificial Sequence: Synthetic oligonucleotide
guuacauuaagaaauaguacuaguaag

SEQ ID NO: 2932 - RNA, 27 nt, Artificial Sequence
  Description of Artificial Sequence: Synthetic oligonucleotide
uguuacauuaagaaauaguacuaguaa

SEQ ID NO: 2933 - RNA, 27 nt, Artificial Sequence
  Description of Artificial Sequence: Synthetic oligonucleotide
aaacauguuacauuaagaaauaguacu

SEQ ID NO: 2934 - RNA, 27 nt, Artificial Sequence
  Description of Artificial Sequence: Synthetic oligonucleotide
uaaacauguuacauuaagaaauaguac

SEQ ID NO: 2935 - RNA, 27 nt, Artificial Sequence
  Description of Artificial Sequence: Synthetic oligonucleotide
guaaacauguuacauuaagaaauagua

SEQ ID NO: 2936 - RNA, 27 nt, Artificial Sequence
  Description of Artificial Sequence: Synthetic oligonucleotide
auuccagguaaacauguuacauuaaga

SEQ ID NO: 2937 - RNA, 27 nt, Artificial Sequence
  Description of Artificial Sequence: Synthetic oligonucleotide
aaaaauaguuaaaauacauuccaggua

SEQ ID NO: 2938 - RNA, 27 nt, Artificial Sequence
  Description of Artificial Sequence: Synthetic oligonucleotide
acaaaaauaguuaaaauacauuccagg

SEQ ID NO: 2939 - RNA, 27 nt, Artificial Sequence
  Description of Artificial Sequence: Synthetic oligonucleotide
uacaaaaauaguuaaaauacauuccag

SEQ ID NO: 2940 - RNA, 27 nt, Artificial Sequence
  Description of Artificial Sequence: Synthetic oligonucleotide
auacaaaaauaguuaaaauacauucca

SEQ ID NO: 2941 - RNA, 27 nt, Artificial Sequence
  Description of Artificial Sequence: Synthetic oligonucleotide
uauacaaaaauaguuaaaauacauucc

SEQ ID NO: 2942 - RNA, 27 nt, Artificial Sequence
  Description of Artificial Sequence: Synthetic oligonucleotide
acuauacaaaaauaguuaaaauacauu

SEQ ID NO: 2943 - RNA, 27 nt, Artificial Sequence
  Description of Artificial Sequence: Synthetic oligonucleotide
acacuauacaaaaauaguuaaaauaca

SEQ ID NO: 2944 - RNA, 27 nt, Artificial Sequence
  Description of Artificial Sequence: Synthetic oligonucleotide
uacacuauacaaaaauaguuaaaauac

SEQ ID NO: 2945 - RNA, 27 nt, Artificial Sequence
  Description of Artificial Sequence: Synthetic oligonucleotide
uuacacuauacaaaaauaguuaaaaua

SEQ ID NO: 2946 - RNA, 27 nt, Artificial Sequence
  Description of Artificial Sequence: Synthetic oligonucleotide
uuucaguuuacacuauacaaaaauagu

SEQ ID NO: 2947 - RNA, 27 nt, Artificial Sequence
  Description of Artificial Sequence: Synthetic oligonucleotide
guuucaguuuacacuauacaaaaauag

SEQ ID NO: 2948 - RNA, 27 nt, Artificial Sequence
  Description of Artificial Sequence: Synthetic oligonucleotide
uguuucaguuuacacuauacaaaaaua

SEQ ID NO: 2949 - RNA, 27 nt, Artificial Sequence
  Description of Artificial Sequence: Synthetic oligonucleotide
uguacaaaaugugcauguuucaguuua

SEQ ID NO: 2950 - RNA, 27 nt, Artificial Sequence
  Description of Artificial Sequence: Synthetic oligonucleotide
gcacaauguacaaaaugugcauguuuc

SEQ ID NO: 2951 - RNA, 27 nt, Artificial Sequence
  Description of Artificial Sequence: Synthetic oligonucleotide
aaccaaaugauggaaaacaacuggauc

SEQ ID NO: 2952 - RNA, 27 nt, Artificial Sequence
  Description of Artificial Sequence: Synthetic oligonucleotide
gcaaccaaaugauggaaaacaacugga

SEQ ID NO: 2953 - RNA, 27 nt, Artificial Sequence
  Description of Artificial Sequence: Synthetic oligonucleotide
uuuuaauguuugauaugaccaacauuc

SEQ ID NO: 2954 - RNA, 27 nt, Artificial Sequence
  Description of Artificial Sequence: Synthetic oligonucleotide
uuuuuaauguuugauaugaccaacauu

SEQ ID NO: 2955 - RNA, 27 nt, Artificial Sequence
  Description of Artificial Sequence: Synthetic oligonucleotide
auuuuuaauguuugauaugaccaacau

SEQ ID NO: 2956 - RNA, 27 nt, Artificial Sequence
  Description of Artificial Sequence: Synthetic oligonucleotide
ggucauuuuuaauguuugauaugacca

SEQ ID NO: 2957 - RNA, 27 nt, Artificial Sequence
  Description of Artificial Sequence: Synthetic oligonucleotide
uuucaauuaaaagaguggucauuuuua

SEQ ID NO: 2958 - RNA, 27 nt, Artificial Sequence
  Description of Artificial Sequence: Synthetic oligonucleotide
auuucaauuaaaagaguggucauuuuu

SEQ ID NO: 2959 - RNA, 27 nt, Artificial Sequence
  Description of Artificial Sequence: Synthetic oligonucleotide
uaaaaguuaauuucaauuaaaagagug

SEQ ID NO: 2960 - RNA, 27 nt, Artificial Sequence
  Description of Artificial Sequence: Synthetic oligonucleotide
uuaaaaguuaauuucaauuaaaagagu

SEQ ID NO: 2961 - RNA, 27 nt, Artificial Sequence
  Description of Artificial Sequence: Synthetic oligonucleotide
auuuaaaaguuaauuucaauuaaaaga

SEQ ID NO: 2962 - RNA, 27 nt, Artificial Sequence
  Description of Artificial Sequence: Synthetic oligonucleotide
acauuuaaaaguuaauuucaauuaaaa

SEQ ID NO: 2963 - RNA, 27 nt, Artificial Sequence
  Description of Artificial Sequence: Synthetic oligonucleotide
aacauuuaaaaguuaauuucaauuaaa

SEQ ID NO: 2964 - RNA, 27 nt, Artificial Sequence
  Description of Artificial Sequence: Synthetic oligonucleotide
aaacauuuaaaaguuaauuucaauuaa

SEQ ID NO: 2965 - RNA, 27 nt, Artificial Sequence
  Description of Artificial Sequence: Synthetic oligonucleotide
uaaacauuuaaaaguuaauuucaauua

SEQ ID NO: 2966 - RNA, 27 nt, Artificial Sequence
  Description of Artificial Sequence: Synthetic oligonucleotide
auaaacauuuaaaaguuaauuucaauu

SEQ ID NO: 2967 - RNA, 27 nt, Artificial Sequence
  Description of Artificial Sequence: Synthetic oligonucleotide
uauaaacauuuaaaaguuaauuucaau

SEQ ID NO: 2968 - RNA, 27 nt, Artificial Sequence
  Description of Artificial Sequence: Synthetic oligonucleotide
uccuauaaacauuuaaaaguuaauuuc

SEQ ID NO: 2969 - RNA, 27 nt, Artificial Sequence
  Description of Artificial Sequence: Synthetic oligonucleotide
auacuccuauaaacauuuaaaaguuaa

SEQ ID NO: 2970 - RNA, 27 nt, Artificial Sequence
  Description of Artificial Sequence: Synthetic oligonucleotide
gcacauacuccuauaaacauuuaaaag

SEQ ID NO: 2971 - RNA, 27 nt, Artificial Sequence
  Description of Artificial Sequence: Synthetic oligonucleotide
agcacauacuccuauaaacauuuaaaa

SEQ ID NO: 2972 - RNA, 27 nt, Artificial Sequence
  Description of Artificial Sequence: Synthetic oligonucleotide
uacaaauuuuagaucacuucacagcac

SEQ ID NO: 2973 - RNA, 27 nt, Artificial Sequence
  Description of Artificial Sequence: Synthetic oligonucleotide
auuacaaauuuuagaucacuucacagc

SEQ ID NO: 2974 - RNA, 27 nt, Artificial Sequence
  Description of Artificial Sequence: Synthetic oligonucleotide
uauuacaaauuuuagaucacuucacag

SEQ ID NO: 2975 - RNA, 27 nt, Artificial Sequence
  Description of Artificial Sequence: Synthetic oligonucleotide
auauuacaaauuuuagaucacuucaca

SEQ ID NO: 2976 - RNA, 27 nt, Artificial Sequence
  Description of Artificial Sequence: Synthetic oligonucleotide
aauauuacaaauuuuagaucacuucac

SEQ ID NO: 2977 - RNA, 27 nt, Artificial Sequence
  Description of Artificial Sequence: Synthetic oligonucleotide
aaauauuacaaauuuuagaucacuuca

SEQ ID NO: 2978 - RNA, 27 nt, Artificial Sequence
  Description of Artificial Sequence: Synthetic oligonucleotide
aaaauauuacaaauuuuagaucacuuc

SEQ ID NO: 2979 - RNA, 27 nt, Artificial Sequence
  Description of Artificial Sequence: Synthetic oligonucleotide
gacaaaaauauuacaaauuuuagauca

SEQ ID NO: 2980 - RNA, 27 nt, Artificial Sequence
  Description of Artificial Sequence: Synthetic oligonucleotide
ugacaaaaauauuacaaauuuuagauc

SEQ ID NO: 2981 - RNA, 27 nt, Artificial Sequence
  Description of Artificial Sequence: Synthetic oligonucleotide
uucaugacaaaaauauuacaaauuuua

SEQ ID NO: 2982 - RNA, 27 nt, Artificial Sequence
  Description of Artificial Sequence: Synthetic oligonucleotide
guucaugacaaaaauauuacaaauuuu

SEQ ID NO: 2983 - RNA, 27 nt, Artificial Sequence
  Description of Artificial Sequence: Synthetic oligonucleotide
aguucaugacaaaaauauuacaaauuu

SEQ ID NO: 2984 - RNA, 27 nt, Artificial Sequence
  Description of Artificial Sequence: Synthetic oligonucleotide
guacaguucaugacaaaaauauuacaa

SEQ ID NO: 2985 - RNA, 27 nt, Artificial Sequence
  Description of Artificial Sequence: Synthetic oligonucleotide
aguacaguucaugacaaaaauauuaca

SEQ ID NO: 2986 - RNA, 27 nt, Artificial Sequence
  Description of Artificial Sequence: Synthetic oligonucleotide
uacaauaauuaggaguaguacaguuca

SEQ ID NO: 2987 - RNA, 27 nt, Artificial Sequence
  Description of Artificial Sequence: Synthetic oligonucleotide
uuacaauaauuaggaguaguacaguuc

SEQ ID NO: 2988 - RNA, 27 nt, Artificial Sequence
  Description of Artificial Sequence: Synthetic oligonucleotide
uuuuauuacauuacaauaauuaggagu

SEQ ID NO: 2989 - RNA, 27 nt, Artificial Sequence
  Description of Artificial Sequence: Synthetic oligonucleotide
uuuuuauuacauuacaauaauuaggag

SEQ ID NO: 2990 - RNA, 27 nt, Artificial Sequence
  Description of Artificial Sequence: Synthetic oligonucleotide
uauuuuuauuacauuacaauaauuagg

SEQ ID NO: 2991 - RNA, 27 nt, Artificial Sequence
  Description of Artificial Sequence: Synthetic oligonucleotide
acuauuuuuauuacauuacaauaauua

SEQ ID NO: 2992 - RNA, 27 nt, Artificial Sequence
  Description of Artificial Sequence: Synthetic oligonucleotide
aacuauuuuuauuacauuacaauaauu

SEQ ID NO: 2993 - RNA, 27 nt, Artificial Sequence
  Description of Artificial Sequence: Synthetic oligonucleotide
guaacuauuuuuauuacauuacaauaa

SEQ ID NO: 2994 - RNA, 27 nt, Artificial Sequence
  Description of Artificial Sequence: Synthetic oligonucleotide
uguaacuauuuuuauuacauuacaaua

SEQ ID NO: 2995 - RNA, 27 nt, Artificial Sequence
  Description of Artificial Sequence: Synthetic oligonucleotide
ucacuguaacuauuuuuauuacauuac

SEQ ID NO: 2996 - RNA, 27 nt, Artificial Sequence
  Description of Artificial Sequence: Synthetic oligonucleotide
gucacuguaacuauuuuuauuacauua

SEQ ID NO: 2997 - RNA, 27 nt, Artificial Sequence
  Description of Artificial Sequence: Synthetic oligonucleotide
ugucacuguaacuauuuuuauuacauu

SEQ ID NO: 2998 - RNA, 27 nt, Artificial Sequence
  Description of Artificial Sequence: Synthetic oligonucleotide
uuuuuuuuugucacuguaacuauuuuu

SEQ ID NO: 2999 - RNA, 27 nt, Artificial Sequence
  Description of Artificial Sequence: Synthetic oligonucleotide
uuuuuuuuuugucacuguaacuauuuu

SEQ ID NO: 3000 - RNA, 27 nt, Artificial Sequence
  Description of Artificial Sequence: Synthetic oligonucleotide
uuuuuuuuuuuugucacuguaacuauu

SEQ ID NO: 3001 - DNA, 25 bp, Artificial Sequence
  Description of Artificial Sequence: Synthetic oligonucleotide
  Description of Combined DNA/RNA Molecule: Synthetic oligonucleotide
ugcugaaaaugacugaauauaaact

SEQ ID NO: 3002 - DNA, 25 bp, Artificial Sequence
  Description of Artificial Sequence: Synthetic oligonucleotide
  Description of Combined DNA/RNA Molecule: Synthetic oligonucleotide
aaaugacugaauauaaacuuguggt

SEQ ID NO: 3003 - DNA, 25 bp, Artificial Sequence
  Description of Artificial Sequence: Synthetic oligonucleotide
  Description of Combined DNA/RNA Molecule: Synthetic oligonucleotide
gacugaauauaaacuugugguagtt

SEQ ID NO: 3004 - RNA, 25 nt, Artificial Sequence
  Description of Artificial Sequence: Synthetic oligonucleotide
agcuaauucagaaucauuuugugga

SEQ ID NO: 3005 - RNA, 25 nt, Artificial Sequence
  Description of Artificial Sequence: Synthetic oligonucleotide
acgaauaugauccaacaauagagga

SEQ ID NO: 3006 - RNA, 25 nt, Artificial Sequence
  Description of Artificial Sequence: Synthetic oligonucleotide
agcaaguaguaauugauggagaaac

SEQ ID NO: 3007 - RNA, 25 nt, Artificial Sequence
  Description of Artificial Sequence: Synthetic oligonucleotide
ggagggcuuucuuuguguauuugcc

SEQ ID NO: 3008 - DNA, 25 bp, Artificial Sequence
  Description of Artificial Sequence: Synthetic oligonucleotide
  Description of Combined DNA/RNA Molecule: Synthetic oligonucleotide
ucuuuguguauuugccauaaauaat

SEQ ID NO: 3009 - DNA, 25 bp, Artificial Sequence
  Description of Artificial Sequence: Synthetic oligonucleotide
  Description of Combined DNA/RNA Molecule: Synthetic oligonucleotide
cuuuguguauuugccauaaauaata

SEQ ID NO: 3010 - RNA, 25 nt, Artificial Sequence
  Description of Artificial Sequence: Synthetic oligonucleotide
uuuguguauuugccauaaauaauac

SEQ ID NO: 3011 - DNA, 25 bp, Artificial Sequence
  Description of Artificial Sequence: Synthetic oligonucleotide
  Description of Combined DNA/RNA Molecule: Synthetic oligonucleotide
uuguguauuugccauaaauaauact

SEQ ID NO: 3012 - DNA, 25 bp, Artificial Sequence
  Description of Artificial Sequence: Synthetic oligonucleotide
  Description of Combined DNA/RNA Molecule: Synthetic oligonucleotide
guauuugccauaaauaauacuaaat

SEQ ID NO: 3013 - DNA, 25 bp, Artificial Sequence
  Description of Artificial Sequence: Synthetic oligonucleotide
  Description of Combined DNA/RNA Molecule: Synthetic oligonucleotide
uauuugccauaaauaauacuaaatc

SEQ ID NO: 3014 - RNA, 25 nt, Artificial Sequence
  Description of Artificial Sequence: Synthetic oligonucleotide
ccauaaauaauacuaaaucauuuga

SEQ ID NO: 3015 - RNA, 25 nt, Artificial Sequence
  Description of Artificial Sequence: Synthetic oligonucleotide
cauaaauaauacuaaaucauuugaa

SEQ ID NO: 3016 - RNA, 25 nt, Artificial Sequence
  Description of Artificial Sequence: Synthetic oligonucleotide
uaaauaauacuaaaucauuugaaga

SEQ ID NO: 3017 - DNA, 25 bp, Artificial Sequence
  Description of Artificial Sequence: Synthetic oligonucleotide
  Description of Combined DNA/RNA Molecule: Synthetic oligonucleotide
aaauaauacuaaaucauuugaagat

SEQ ID NO: 3018 - DNA, 25 bp, Artificial Sequence
  Description of Artificial Sequence: Synthetic oligonucleotide
  Description of Combined DNA/RNA Molecule: Synthetic oligonucleotide
aauaauacuaaaucauuugaagata

SEQ ID NO: 3019 - DNA, 25 bp, Artificial Sequence
  Description of Artificial Sequence: Synthetic oligonucleotide
  Description of Combined DNA/RNA Molecule: Synthetic oligonucleotide
auaauacuaaaucauuugaagauat

SEQ ID NO: 3020 - RNA, 25 nt, Artificial Sequence
  Description of Artificial Sequence: Synthetic oligonucleotide
auuugaagauauucaccauuauaga

SEQ ID NO: 3021 - RNA, 25 nt, Artificial Sequence
  Description of Artificial Sequence: Synthetic oligonucleotide
uugaagauauucaccauuauagaga

SEQ ID NO: 3022 - RNA, 25 nt, Artificial Sequence
  Description of Artificial Sequence: Synthetic oligonucleotide
ugaagauauucaccauuauagagaa

SEQ ID NO: 3023 - RNA, 25 nt, Artificial Sequence
  Description of Artificial Sequence: Synthetic oligonucleotide
gaagauauucaccauuauagagaac

SEQ ID NO: 3024 - RNA, 25 nt, Artificial Sequence
  Description of Artificial Sequence: Synthetic oligonucleotide
aagauauucaccauuauagagaaca

SEQ ID NO: 3025 - RNA, 25 nt, Artificial Sequence
  Description of Artificial Sequence: Synthetic oligonucleotide
ccauuauagagaacaaauuaaaaga

SEQ ID NO: 3026 - DNA, 25 bp, Artificial Sequence
  Description of Artificial Sequence: Synthetic oligonucleotide
  Description of Combined DNA/RNA Molecule: Synthetic oligonucleotide
auuauagagaacaaauuaaaagagt

SEQ ID NO: 3027 - DNA, 25 bp, Artificial Sequence
  Description of Artificial Sequence: Synthetic oligonucleotide
  Description of Combined DNA/RNA Molecule: Synthetic oligonucleotide
uuauagagaacaaauuaaaagagtt

SEQ ID NO: 3028 - DNA, 25 bp, Artificial Sequence
  Description of Artificial Sequence: Synthetic oligonucleotide
  Description of Combined DNA/RNA Molecule: Synthetic oligonucleotide
uauagagaacaaauuaaaagaguta

SEQ ID NO: 3029 - RNA, 25 nt, Artificial Sequence
  Description of Artificial Sequence: Synthetic oligonucleotide
auagagaacaaauuaaaagaguuaa

SEQ ID NO: 3030 - RNA, 25 nt, Artificial Sequence
  Description of Artificial Sequence: Synthetic oligonucleotide
cuaguaggaaauaaaugugauuugc

SEQ ID NO: 3031 - RNA, 25 nt, Artificial Sequence
  Description of Artificial Sequence: Synthetic oligonucleotide
uaguaggaaauaaaugugauuugcc

SEQ ID NO: 3032 - DNA, 25 bp, Artificial Sequence
  Description of Artificial Sequence: Synthetic oligonucleotide
  Description of Combined DNA/RNA Molecule: Synthetic oligonucleotide
aagaaguuauggaauuccuuuuatt

SEQ ID NO: 3033 - RNA, 25 nt, Artificial Sequence
  Description of Artificial Sequence: Synthetic oligonucleotide
aaguuauggaauuccuuuuauugaa

SEQ ID NO: 3034 - RNA, 25 nt, Artificial Sequence
  Description of Artificial Sequence: Synthetic oligonucleotide
aguuauggaauuccuuuuauugaaa

SEQ ID NO: 3035 - RNA, 25 nt, Artificial Sequence
  Description of Artificial Sequence: Synthetic oligonucleotide
guuauggaauuccuuuuauugaaac

SEQ ID NO: 3036 - RNA, 25 nt, Artificial Sequence
  Description of Artificial Sequence: Synthetic oligonucleotide
uuauggaauuccuuuuauugaaaca

SEQ ID NO: 3037 - DNA, 25 bp, Artificial Sequence
  Description of Artificial Sequence: Synthetic oligonucleotide
  Description of Combined DNA/RNA Molecule: Synthetic oligonucleotide
uggaggaugcuuuuuauacauuggt

SEQ ID NO: 3038 - RNA, 25 nt, Artificial Sequence
  Description of Artificial Sequence: Synthetic oligonucleotide
gaggaugcuuuuuauacauugguga

SEQ ID NO: 3039 - RNA, 25 nt, Artificial Sequence
  Description of Artificial Sequence: Synthetic oligonucleotide
acagauugaaaaaaaucagcaaaga

SEQ ID NO: 3040 - RNA, 25 nt, Artificial Sequence
  Description of Artificial Sequence: Synthetic oligonucleotide
cagauugaaaaaaaucagcaaagaa

SEQ ID NO: 3041 - RNA, 25 nt, Artificial Sequence
  Description of Artificial Sequence: Synthetic oligonucleotide
gauugaaaaaaaucagcaaagaaga

SEQ ID NO: 3042 - RNA, 25 nt, Artificial Sequence
  Description of Artificial Sequence: Synthetic oligonucleotide
auugaaaaaaaucagcaaagaagaa

SEQ ID NO: 3043 - RNA, 25 nt, Artificial Sequence
  Description of Artificial Sequence: Synthetic oligonucleotide
uugaaaaaaaucagcaaagaagaaa

SEQ ID NO: 3044 - RNA, 25 nt, Artificial Sequence
  Description of Artificial Sequence: Synthetic oligonucleotide
ugaaaaaaaucagcaaagaagaaaa

SEQ ID NO: 3045 - RNA, 25 nt, Artificial Sequence
  Description of Artificial Sequence: Synthetic oligonucleotide
uccuggcugugugaaaauuaaaaaa

SEQ ID NO: 3046 - RNA, 25 nt, Artificial Sequence
  Description of Artificial Sequence: Synthetic oligonucleotide
ggcugugugaaaauuaaaaaaugca

SEQ ID NO: 3047 - DNA, 25 bp, Artificial Sequence
  Description of Artificial Sequence: Synthetic oligonucleotide
  Description of Combined DNA/RNA Molecule: Synthetic oligonucleotide
gugugaaaauuaaaaaaugcauuat

SEQ ID NO: 3048 - DNA, 25 bp, Artificial Sequence
  Description of Artificial Sequence: Synthetic oligonucleotide
  Description of Combined DNA/RNA Molecule: Synthetic oligonucleotide
ugugaaaauuaaaaaaugcauuata

SEQ ID NO: 3049 - RNA, 25 nt, Artificial Sequence
  Description of Artificial Sequence: Synthetic oligonucleotide
gugaaaauuaaaaaaugcauuauaa

SEQ ID NO: 3050 - DNA, 25 bp, Artificial Sequence
  Description of Artificial Sequence: Synthetic oligonucleotide
  Description of Combined DNA/RNA Molecule: Synthetic oligonucleotide
ugaaaauuaaaaaaugcauuauaat

SEQ ID NO: 3051 - DNA, 25 bp, Artificial Sequence
  Description of Artificial Sequence: Synthetic oligonucleotide
  Description of Combined DNA/RNA Molecule: Synthetic oligonucleotide
aaaauuaaaaaaugcauuauaaugt

SEQ ID NO: 3052 - DNA, 25 bp, Artificial Sequence
  Description of Artificial Sequence: Synthetic oligonucleotide
  Description of Combined DNA/RNA Molecule: Synthetic oligonucleotide
aaauuaaaaaaugcauuauaaugta

SEQ ID NO: 3053 - RNA, 25 nt, Artificial Sequence
  Description of Artificial Sequence: Synthetic oligonucleotide
aauuaaaaaaugcauuauaauguaa

SEQ ID NO: 3054 - DNA, 25 bp, Artificial Sequence
  Description of Artificial Sequence: Synthetic oligonucleotide
  Description of Combined DNA/RNA Molecule: Synthetic oligonucleotide
auuaaaaaaugcauuauaauguaat

SEQ ID NO: 3055 - DNA, 25 bp, Artificial Sequence
  Description of Artificial Sequence: Synthetic oligonucleotide
  Description of Combined DNA/RNA Molecule: Synthetic oligonucleotide
uaaaaaaugcauuauaauguaauct

SEQ ID NO: 3056 - DNA, 25 bp, Artificial Sequence
  Description of Artificial Sequence: Synthetic oligonucleotide
  Description of Combined DNA/RNA Molecule: Synthetic oligonucleotide
ugcauuauaauguaaucugggugtt

SEQ ID NO: 3057 - RNA, 25 nt, Artificial Sequence
  Description of Artificial Sequence: Synthetic oligonucleotide
uucgagaaauucgaaaacauaaaga

SEQ ID NO: 3058 - RNA, 25 nt, Artificial Sequence
  Description of Artificial Sequence: Synthetic oligonucleotide
ucgagaaauucgaaaacauaaagaa

SEQ ID NO: 3059 - RNA, 25 nt, Artificial Sequence
  Description of Artificial Sequence: Synthetic oligonucleotide
cgagaaauucgaaaacauaaagaaa

SEQ ID NO: 3060 - RNA, 25 nt, Artificial Sequence
  Description of Artificial Sequence: Synthetic oligonucleotide
gaaauucgaaaacauaaagaaaaga

SEQ ID NO: 3061 - RNA, 25 nt, Artificial Sequence
  Description of Artificial Sequence: Synthetic oligonucleotide
ucgaaaacauaaagaaaagaugagc

SEQ ID NO: 3062 - RNA, 25 nt, Artificial Sequence
  Description of Artificial Sequence: Synthetic oligonucleotide
cgaaaacauaaagaaaagaugagca

SEQ ID NO: 3063 - RNA, 25 nt, Artificial Sequence
  Description of Artificial Sequence: Synthetic oligonucleotide
aaagaugguaaaaagaagaaaaaga

SEQ ID NO: 3064 - RNA, 25 nt, Artificial Sequence
  Description of Artificial Sequence: Synthetic oligonucleotide
aagaugguaaaaagaagaaaaagaa

SEQ ID NO: 3065 - DNA, 25 bp, Artificial Sequence
  Description of Artificial Sequence: Synthetic oligonucleotide
  Description of Combined DNA/RNA Molecule: Synthetic oligonucleotide
gaugguaaaaagaagaaaaagaagt

SEQ ID NO: 3066 - DNA, 25 bp, Artificial Sequence
  Description of Artificial Sequence: Synthetic oligonucleotide
  Description of Combined DNA/RNA Molecule: Synthetic oligonucleotide
augguaaaaagaagaaaaagaagtc

SEQ ID NO: 3067 - RNA, 25 nt, Artificial Sequence
  Description of Artificial Sequence: Synthetic oligonucleotide
aaaaagaagaaaaagaagucaaaga

SEQ ID NO: 3068 - RNA, 25 nt, Artificial Sequence
  Description of Artificial Sequence: Synthetic oligonucleotide
aaaagaagaaaaagaagucaaagac

SEQ ID NO: 3069 - RNA, 25 nt, Artificial Sequence
  Description of Artificial Sequence: Synthetic oligonucleotide
aaagaagaaaaagaagucaaagaca

SEQ ID NO: 3070 - DNA, 25 bp, Artificial Sequence
  Description of Artificial Sequence: Synthetic oligonucleotide
  Description of Combined DNA/RNA Molecule: Synthetic oligonucleotide
ucaaagacaaaguguguaauuaugt

SEQ ID NO: 3071 - DNA, 25 bp, Artificial Sequence
  Description of Artificial Sequence: Synthetic oligonucleotide
  Description of Combined DNA/RNA Molecule: Synthetic oligonucleotide
caaagacaaaguguguaauuaugta

SEQ ID NO: 3072 - DNA, 25 bp, Artificial Sequence
  Description of Artificial Sequence: Synthetic oligonucleotide
  Description of Combined DNA/RNA Molecule: Synthetic oligonucleotide
gacaaaguguguaauuauguaaata

SEQ ID NO: 3073 - RNA, 25 nt, Artificial Sequence
  Description of Artificial Sequence: Synthetic oligonucleotide
caaaguguguaauuauguaaauaca

SEQ ID NO: 3074 - DNA, 25 bp, Artificial Sequence
  Description of Artificial Sequence: Synthetic oligonucleotide
  Description of Combined DNA/RNA Molecule: Synthetic oligonucleotide
guguguaauuauguaaauacaautt

SEQ ID NO: 3075 - DNA, 25 bp, Artificial Sequence
  Description of Artificial Sequence: Synthetic oligonucleotide
  Description of Combined DNA/RNA Molecule: Synthetic oligonucleotide
guguaauuauguaaauacaauuugt

SEQ ID NO: 3076 - RNA, 25 nt, Artificial Sequence
  Description of Artificial Sequence: Synthetic oligonucleotide
guaauuauguaaauacaauuuguac

SEQ ID NO: 3077 - DNA, 25 bp, Artificial Sequence
  Description of Artificial Sequence: Synthetic oligonucleotide
  Description of Combined DNA/RNA Molecule: Synthetic oligonucleotide
uaauuauguaaauacaauuuguact

SEQ ID NO: 3078 - DNA, 25 bp, Artificial Sequence
  Description of Artificial Sequence: Synthetic oligonucleotide
  Description of Combined DNA/RNA Molecule: Synthetic oligonucleotide
uauguaaauacaauuuguacuuutt

SEQ ID NO: 3079 - DNA, 25 bp, Artificial Sequence
  Description of Artificial Sequence: Synthetic oligonucleotide
  Description of Combined DNA/RNA Molecule: Synthetic oligonucleotide
auguaaauacaauuuguacuuuutt

SEQ ID NO: 3080 - DNA, 25 bp, Artificial Sequence
  Description of Artificial Sequence: Synthetic oligonucleotide
  Description of Combined DNA/RNA Molecule: Synthetic oligonucleotide
uguaaauacaauuuguacuuuuutc

SEQ ID NO: 3081 - DNA, 25 bp, Artificial Sequence
  Description of Artificial Sequence: Synthetic oligonucleotide
  Description of Combined DNA/RNA Molecule: Synthetic oligonucleotide
guaaauacaauuuguacuuuuuuct

SEQ ID NO: 3082 - RNA, 25 nt, Artificial Sequence
  Description of Artificial Sequence: Synthetic oligonucleotide
acaauuuguacuuuuuucuuaaggc

SEQ ID NO: 3083 - RNA, 25 nt, Artificial Sequence
  Description of Artificial Sequence: Synthetic oligonucleotide
caauuuguacuuuuuucuuaaggca

SEQ ID NO: 3084 - DNA, 25 bp, Artificial Sequence
  Description of Artificial Sequence: Synthetic oligonucleotide
  Description of Combined DNA/RNA Molecule: Synthetic oligonucleotide
uacuaguacaagugguaauuuuugt

SEQ ID NO: 3085 - DNA, 25 bp, Artificial Sequence
  Description of Artificial Sequence: Synthetic oligonucleotide
  Description of Combined DNA/RNA Molecule: Synthetic oligonucleotide
acuaguacaagugguaauuuuugta

SEQ ID NO: 3086 - RNA, 25 nt, Artificial Sequence
  Description of Artificial Sequence: Synthetic oligonucleotide
acaagugguaauuuuuguacauuac

SEQ ID NO: 3087 - RNA, 25 nt, Artificial Sequence
  Description of Artificial Sequence: Synthetic oligonucleotide
caagugguaauuuuuguacauuaca

SEQ ID NO: 3088 - DNA, 25 bp, Artificial Sequence
  Description of Artificial Sequence: Synthetic oligonucleotide
  Description of Combined DNA/RNA Molecule: Synthetic oligonucleotide
uaauuuuuguacauuacacuaaatt

SEQ ID NO: 3089 - DNA, 25 bp, Artificial Sequence
  Description of Artificial Sequence: Synthetic oligonucleotide
  Description of Combined DNA/RNA Molecule: Synthetic oligonucleotide
aauuuuuguacauuacacuaaauta

SEQ ID NO: 3090 - DNA, 25 bp, Artificial Sequence
  Description of Artificial Sequence: Synthetic oligonucleotide
  Description of Combined DNA/RNA Molecule: Synthetic oligonucleotide
auuuuuguacauuacacuaaauuat

SEQ ID NO: 3091 - DNA, 25 bp, Artificial Sequence
  Description of Artificial Sequence: Synthetic oligonucleotide
  Description of Combined DNA/RNA Molecule: Synthetic oligonucleotide
uuuuuguacauuacacuaaauuatt

SEQ ID NO: 3092 - DNA, 25 bp, Artificial Sequence
  Description of Artificial Sequence: Synthetic oligonucleotide
  Description of Combined DNA/RNA Molecule: Synthetic oligonucleotide
uuuuguacauuacacuaaauuauta

SEQ ID NO: 3093 - DNA, 25 bp, Artificial Sequence
  Description of Artificial Sequence: Synthetic oligonucleotide
  Description of Combined DNA/RNA Molecule: Synthetic oligonucleotide
cacuaaauuauuagcauuuguuuta

SEQ ID NO: 3094 - RNA, 25 nt, Artificial Sequence
  Description of Artificial Sequence: Synthetic oligonucleotide
cuaaauuauuagcauuuguuuuagc

SEQ ID NO: 3095 - RNA, 25 nt, Artificial Sequence
  Description of Artificial Sequence: Synthetic oligonucleotide
uaaauuauuagcauuuguuuuagca

SEQ ID NO: 3096 - RNA, 25 nt, Artificial Sequence
  Description of Artificial Sequence: Synthetic oligonucleotide
uauuagcauuuguuuuagcauuacc

SEQ ID NO: 3097 - DNA, 25 bp, Artificial Sequence
  Description of Artificial Sequence: Synthetic oligonucleotide
  Description of Combined DNA/RNA Molecule: Synthetic oligonucleotide
cauuuguuuuagcauuaccuaautt

SEQ ID NO: 3098 - DNA, 25 bp, Artificial Sequence
  Description of Artificial Sequence: Synthetic oligonucleotide
  Description of Combined DNA/RNA Molecule: Synthetic oligonucleotide
auuuguuuuagcauuaccuaauutt

SEQ ID NO: 3099 - DNA, 25 bp, Artificial Sequence
  Description of Artificial Sequence: Synthetic oligonucleotide
  Description of Combined DNA/RNA Molecule: Synthetic oligonucleotide
uuguuuuagcauuaccuaauuuutt

SEQ ID NO: 3100 - DNA, 25 bp, Artificial Sequence
  Description of Artificial Sequence: Synthetic oligonucleotide
  Description of Combined DNA/RNA Molecule: Synthetic oligonucleotide
uguuuuagcauuaccuaauuuuutt

SEQ ID NO: 3101 - DNA, 25 bp, Artificial Sequence
  Description of Artificial Sequence: Synthetic oligonucleotide
  Description of Combined DNA/RNA Molecule: Synthetic oligonucleotide
guuuuagcauuaccuaauuuuuutc

SEQ ID NO: 3102 - RNA, 25 nt, Artificial Sequence
  Description of Artificial Sequence: Synthetic oligonucleotide
uuuuagcauuaccuaauuuuuuucc

SEQ ID NO: 3103 - RNA, 25 nt, Artificial Sequence
  Description of Artificial Sequence: Synthetic oligonucleotide
gacuguuagcuuuuaccuuaaaugc

SEQ ID NO: 3104 - DNA, 25 bp, Artificial Sequence
  Description of Artificial Sequence: Synthetic oligonucleotide
  Description of Combined DNA/RNA Molecule: Synthetic oligonucleotide
acuguuagcuuuuaccuuaaaugct

SEQ ID NO: 3105 - DNA, 25 bp, Artificial Sequence
  Description of Artificial Sequence: Synthetic oligonucleotide
  Description of Combined DNA/RNA Molecule: Synthetic oligonucleotide
agcuuuuaccuuaaaugcuuauutt

SEQ ID NO: 3106 - DNA, 25 bp, Artificial Sequence
  Description of Artificial Sequence: Synthetic oligonucleotide
  Description of Combined DNA/RNA Molecule: Synthetic oligonucleotide
gcuuuuaccuuaaaugcuuauuuta

SEQ ID NO: 3107 - RNA, 25 nt, Artificial Sequence
  Description of Artificial Sequence: Synthetic oligonucleotide
cuuuuaccuuaaaugcuuauuuuaa

SEQ ID NO: 3108 - RNA, 25 nt, Artificial Sequence
  Description of Artificial Sequence: Synthetic oligonucleotide
ccuuaaaugcuuauuuuaaaaugac

SEQ ID NO: 3109 - RNA, 25 nt, Artificial Sequence
  Description of Artificial Sequence: Synthetic oligonucleotide
cuuaaaugcuuauuuuaaaaugaca

SEQ ID NO: 3110 - RNA, 25 nt, Artificial Sequence
  Description of Artificial Sequence: Synthetic oligonucleotide
ugcuuauuuuaaaaugacaguggaa

SEQ ID NO: 3111 - DNA, 25 bp, Artificial Sequence
  Description of Artificial Sequence: Synthetic oligonucleotide
  Description of Combined DNA/RNA Molecule: Synthetic oligonucleotide
cuuauuuuaaaaugacaguggaagt

SEQ ID NO: 3112 - DNA, 25 bp, Artificial Sequence
  Description of Artificial Sequence: Synthetic oligonucleotide
  Description of Combined DNA/RNA Molecule: Synthetic oligonucleotide
guggaaguuuuuuuuuccucuaagt

SEQ ID NO: 3113 - RNA, 25 nt, Artificial Sequence
  Description of Artificial Sequence: Synthetic oligonucleotide
ggaaguuuuuuuuuccucuaagugc

SEQ ID NO: 3114 - RNA, 25 nt, Artificial Sequence
  Description of Artificial Sequence: Synthetic oligonucleotide
gaaguuuuuuuuuccucuaagugcc

SEQ ID NO: 3115 - RNA, 25 nt, Artificial Sequence
  Description of Artificial Sequence: Synthetic oligonucleotide
uuuugguuuuugaacuagcaaugcc

SEQ ID NO: 3116 - RNA, 25 nt, Artificial Sequence
  Description of Artificial Sequence: Synthetic oligonucleotide
gccugugaaaaagaaacugaauacc

SEQ ID NO: 3117 - DNA, 25 bp, Artificial Sequence
  Description of Artificial Sequence: Synthetic oligonucleotide
  Description of Combined DNA/RNA Molecule: Synthetic oligonucleotide
aaaaagaaacugaauaccuaagatt

SEQ ID NO: 3118 - DNA, 25 bp, Artificial Sequence
  Description of Artificial Sequence: Synthetic oligonucleotide
  Description of Combined DNA/RNA Molecule: Synthetic oligonucleotide
aaaagaaacugaauaccuaagautt

SEQ ID NO: 3119 - DNA, 25 bp, Artificial Sequence
  Description of Artificial Sequence: Synthetic oligonucleotide
  Description of Combined DNA/RNA Molecule: Synthetic oligonucleotide
aacugaauaccuaagauuucuguct

SEQ ID NO: 3120 - DNA, 25 bp, Artificial Sequence
  Description of Artificial Sequence: Synthetic oligonucleotide
  Description of Combined DNA/RNA Molecule: Synthetic oligonucleotide
ugcaguugauuacuucuuauuuutc

SEQ ID NO: 3121 - DNA, 25 bp, Artificial Sequence
  Description of Artificial Sequence: Synthetic oligonucleotide
  Description of Combined DNA/RNA Molecule: Synthetic oligonucleotide
gcaguugauuacuucuuauuuuuct

SEQ ID NO: 3122 - RNA, 25 nt, Artificial Sequence
  Description of Artificial Sequence: Synthetic oligonucleotide
uugauuacuucuuauuuuucuuacc

SEQ ID NO: 3123 - RNA, 25 nt, Artificial Sequence
  Description of Artificial Sequence: Synthetic oligonucleotide
uucuuauuuuucuuaccaauuguga

SEQ ID NO: 3124 - RNA, 25 nt, Artificial Sequence
  Description of Artificial Sequence: Synthetic oligonucleotide
ucuuauuuuucuuaccaauugugaa

SEQ ID NO: 3125 - DNA, 25 bp, Artificial Sequence
  Description of Artificial Sequence: Synthetic oligonucleotide
  Description of Combined DNA/RNA Molecule: Synthetic oligonucleotide
cuuauuuuucuuaccaauugugaat

SEQ ID NO: 3126 - RNA, 25 nt, Artificial Sequence
  Description of Artificial Sequence: Synthetic oligonucleotide
auguuggugugaaacaaauuaauga

SEQ ID NO: 3127 - RNA, 25 nt, Artificial Sequence
  Description of Artificial Sequence: Synthetic oligonucleotide
uuggugugaaacaaauuaaugaagc

SEQ ID NO: 3128 - DNA, 25 bp, Artificial Sequence
  Description of Artificial Sequence: Synthetic oligonucleotide
  Description of Combined DNA/RNA Molecule: Synthetic oligonucleotide
uggugugaaacaaauuaaugaagct

SEQ ID NO: 3129 - DNA, 25 bp, Artificial Sequence
  Description of Artificial Sequence: Synthetic oligonucleotide
  Description of Combined DNA/RNA Molecule: Synthetic oligonucleotide
aacaaauuaaugaagcuuuugaatc

SEQ ID NO: 3130 - RNA, 25 nt, Artificial Sequence
  Description of Artificial Sequence: Synthetic oligonucleotide
acaaauuaaugaagcuuuugaauca

SEQ ID NO: 3131 - RNA, 25 nt, Artificial Sequence
  Description of Artificial Sequence: Synthetic oligonucleotide
ucuguguuuuaucuagucacauaaa

SEQ ID NO: 3132 - DNA, 25 bp, Artificial Sequence
  Description of Artificial Sequence: Synthetic oligonucleotide
  Description of Combined DNA/RNA Molecule: Synthetic oligonucleotide
cuguguuuuaucuagucacauaaat

SEQ ID NO: 3133 - RNA, 25 nt, Artificial Sequence
  Description of Artificial Sequence: Synthetic oligonucleotide
uguuuuaucuagucacauaaaugga

SEQ ID NO: 3134 - DNA, 25 bp, Artificial Sequence
  Description of Artificial Sequence: Synthetic oligonucleotide
  Description of Combined DNA/RNA Molecule: Synthetic oligonucleotide
guuuuaucuagucacauaaauggat

SEQ ID NO: 3135 - DNA, 25 bp, Artificial Sequence
  Description of Artificial Sequence: Synthetic oligonucleotide
  Description of Combined DNA/RNA Molecule: Synthetic oligonucleotide
aucuagucacauaaauggauuaatt

SEQ ID NO: 3136 - DNA, 25 bp, Artificial Sequence
  Description of Artificial Sequence: Synthetic oligonucleotide
  Description of Combined DNA/RNA Molecule: Synthetic oligonucleotide
ucuagucacauaaauggauuaauta

SEQ ID NO: 3137 - DNA, 25 bp, Artificial Sequence
  Description of Artificial Sequence: Synthetic oligonucleotide
  Description of Combined DNA/RNA Molecule: Synthetic oligonucleotide
cauaaauggauuaauuacuaauutc

SEQ ID NO: 3138 - RNA, 25 nt, Artificial Sequence
  Description of Artificial Sequence: Synthetic oligonucleotide
auaaauggauuaauuacuaauuuca

SEQ ID NO: 3139 - RNA, 25 nt, Artificial Sequence
  Description of Artificial Sequence: Synthetic oligonucleotide
uggauuaauuacuaauuucaguuga

SEQ ID NO: 3140 - RNA, 25 nt, Artificial Sequence
  Description of Artificial Sequence: Synthetic oligonucleotide
gauuaauuacuaauuucaguugaga

SEQ ID NO: 3141 - RNA, 25 nt, Artificial Sequence
  Description of Artificial Sequence: Synthetic oligonucleotide
auuaauuacuaauuucaguugagac

SEQ ID NO: 3142 - RNA, 25 nt, Artificial Sequence
  Description of Artificial Sequence: Synthetic oligonucleotide
uuaauuacuaauuucaguugagacc

SEQ ID NO: 3143 - RNA, 25 nt, Artificial Sequence
  Description of Artificial Sequence: Synthetic oligonucleotide
uaauugguuuuuacugaaacauuga

SEQ ID NO: 3144 - RNA, 25 nt, Artificial Sequence
  Description of Artificial Sequence: Synthetic oligonucleotide
ugguuuuuacugaaacauugaggga

SEQ ID NO: 3145 - RNA, 25 nt, Artificial Sequence
  Description of Artificial Sequence: Synthetic oligonucleotide
gguuuuuacugaaacauugagggaa

SEQ ID NO: 3146 - RNA, 25 nt, Artificial Sequence
  Description of Artificial Sequence: Synthetic oligonucleotide
auugagggaacacaaauuuaugggc

SEQ ID NO: 3147 - DNA, 25 bp, Artificial Sequence
  Description of Artificial Sequence: Synthetic oligonucleotide
  Description of Combined DNA/RNA Molecule: Synthetic oligonucleotide
uugagggaacacaaauuuaugggct

SEQ ID NO: 3148 - DNA, 25 bp, Artificial Sequence
  Description of Artificial Sequence: Synthetic oligonucleotide
  Description of Combined DNA/RNA Molecule: Synthetic oligonucleotide
ugaugaauguaaaguuacacugutc

SEQ ID NO: 3149 - RNA, 25 nt, Artificial Sequence
  Description of Artificial Sequence: Synthetic oligonucleotide
gaugaauguaaaguuacacuguuca

SEQ ID NO: 3150 - RNA, 25 nt, Artificial Sequence
  Description of Artificial Sequence: Synthetic oligonucleotide
ccaaaauauuauauuuuuucuauaa

SEQ ID NO: 3151 - RNA, 25 nt, Artificial Sequence
  Description of Artificial Sequence: Synthetic oligonucleotide
caaaauauuauauuuuuucuauaaa

SEQ ID NO: 3152 - RNA, 25 nt, Artificial Sequence
  Description of Artificial Sequence: Synthetic oligonucleotide
aaaauauuauauuuuuucuauaaaa

SEQ ID NO: 3153 - RNA, 25 nt, Artificial Sequence
  Description of Artificial Sequence: Synthetic oligonucleotide
aaauauuauauuuuuucuauaaaaa

SEQ ID NO: 3154 - RNA, 25 nt, Artificial Sequence
  Description of Artificial Sequence: Synthetic oligonucleotide
auauuauauuuuuucuauaaaaaga

SEQ ID NO: 3155 - RNA, 25 nt, Artificial Sequence
  Description of Artificial Sequence: Synthetic oligonucleotide
uauuauauuuuuucuauaaaaagaa

SEQ ID NO: 3156 - RNA, 25 nt, Artificial Sequence
  Description of Artificial Sequence: Synthetic oligonucleotide
auuauauuuuuucuauaaaaagaaa

SEQ ID NO: 3157 - RNA, 25 nt, Artificial Sequence
  Description of Artificial Sequence: Synthetic oligonucleotide
uuauauuuuuucuauaaaaagaaaa

SEQ ID NO: 3158 - RNA, 25 nt, Artificial Sequence
  Description of Artificial Sequence: Synthetic oligonucleotide
uauauuuuuucuauaaaaagaaaaa

SEQ ID NO: 3159 - RNA, 25 nt, Artificial Sequence
  Description of Artificial Sequence: Synthetic oligonucleotide
auauuuuuucuauaaaaagaaaaaa

SEQ ID NO: 3160 - RNA, 25 nt, Artificial Sequence
  Description of Artificial Sequence: Synthetic oligonucleotide
uauuuuuucuauaaaaagaaaaaaa

SEQ ID NO: 3161 - DNA, 25 bp, Artificial Sequence
  Description of Artificial Sequence: Synthetic oligonucleotide
  Description of Combined DNA/RNA Molecule: Synthetic oligonucleotide
auuuuuucuauaaaaagaaaaaaat

SEQ ID NO: 3162 - RNA, 25 nt, Artificial Sequence
  Description of Artificial Sequence: Synthetic oligonucleotide
uucuauaaaaagaaaaaaauggaaa

SEQ ID NO: 3163 - RNA, 25 nt, Artificial Sequence
  Description of Artificial Sequence: Synthetic oligonucleotide
ucuauaaaaagaaaaaaauggaaaa

SEQ ID NO: 3164 - RNA, 25 nt, Artificial Sequence
  Description of Artificial Sequence: Synthetic oligonucleotide
uauaaaaagaaaaaaauggaaaaaa

SEQ ID NO: 3165 - RNA, 25 nt, Artificial Sequence
  Description of Artificial Sequence: Synthetic oligonucleotide
auaaaaagaaaaaaauggaaaaaaa

SEQ ID NO: 3166 - DNA, 25 bp, Artificial Sequence
  Description of Artificial Sequence: Synthetic oligonucleotide
  Description of Combined DNA/RNA Molecule: Synthetic oligonucleotide
uaaaaagaaaaaaauggaaaaaaat

SEQ ID NO: 3167 - DNA, 25 bp, Artificial Sequence
  Description of Artificial Sequence: Synthetic oligonucleotide
  Description of Combined DNA/RNA Molecule: Synthetic oligonucleotide
aaaaagaaaaaaauggaaaaaaatt

SEQ ID NO: 3168 - DNA, 25 bp, Artificial Sequence
  Description of Artificial Sequence: Synthetic oligonucleotide
  Description of Combined DNA/RNA Molecule: Synthetic oligonucleotide
aaaagaaaaaaauggaaaaaaauta

SEQ ID NO: 3169 - RNA, 25 nt, Artificial Sequence
  Description of Artificial Sequence: Synthetic oligonucleotide
aaagaaaaaaauggaaaaaaauuac

SEQ ID NO: 3170 - RNA, 25 nt, Artificial Sequence
  Description of Artificial Sequence: Synthetic oligonucleotide
aagaaaaaaauggaaaaaaauuaca

SEQ ID NO: 3171 - RNA, 25 nt, Artificial Sequence
  Description of Artificial Sequence: Synthetic oligonucleotide
aaaaaauggaaaaaaauuacaaggc

SEQ ID NO: 3172 - RNA, 25 nt, Artificial Sequence
  Description of Artificial Sequence: Synthetic oligonucleotide
aaaaauggaaaaaaauuacaaggca

SEQ ID NO: 3173 - RNA, 25 nt, Artificial Sequence
  Description of Artificial Sequence: Synthetic oligonucleotide
uggaaaaaaauuacaaggcaaugga

SEQ ID NO: 3174 - RNA, 25 nt, Artificial Sequence
  Description of Artificial Sequence: Synthetic oligonucleotide
ggaaaaaaauuacaaggcaauggaa

SEQ ID NO: 3175 - RNA, 25 nt, Artificial Sequence
  Description of Artificial Sequence: Synthetic oligonucleotide
gaaaaaaauuacaaggcaauggaaa

SEQ ID NO: 3176 - RNA, 25 nt, Artificial Sequence
  Description of Artificial Sequence: Synthetic oligonucleotide
gccauuuccuuuucacauuagauaa

SEQ ID NO: 3177 - DNA, 25 bp, Artificial Sequence
  Description of Artificial Sequence: Synthetic oligonucleotide
  Description of Combined DNA/RNA Molecule: Synthetic oligonucleotide
uccuuuucacauuagauaaauuact

SEQ ID NO: 3178 - RNA, 25 nt, Artificial Sequence
  Description of Artificial Sequence: Synthetic oligonucleotide
cacauuagauaaauuacuauaaaga

SEQ ID NO: 3179 - RNA, 25 nt, Artificial Sequence
  Description of Artificial Sequence: Synthetic oligonucleotide
acauuagauaaauuacuauaaagac

SEQ ID NO: 3180 - DNA, 25 bp, Artificial Sequence
  Description of Artificial Sequence: Synthetic oligonucleotide
  Description of Combined DNA/RNA Molecule: Synthetic oligonucleotide
cauuagauaaauuacuauaaagact

SEQ ID NO: 3181 - RNA, 25 nt, Artificial Sequence
  Description of Artificial Sequence: Synthetic oligonucleotide
aguaugaaauggggauuauuauagc

SEQ ID NO: 3182 - DNA, 25 bp, Artificial Sequence
  Description of Artificial Sequence: Synthetic oligonucleotide
  Description of Combined DNA/RNA Molecule: Synthetic oligonucleotide
uggggauuauuauagcaaccauutt

SEQ ID NO: 3183 - DNA, 25 bp, Artificial Sequence
  Description of Artificial Sequence: Synthetic oligonucleotide
  Description of Combined DNA/RNA Molecule: Synthetic oligonucleotide
ggcuauauuuacaugcuacuaaatt

SEQ ID NO: 3184 - DNA, 25 bp, Artificial Sequence
  Description of Artificial Sequence: Synthetic oligonucleotide
  Description of Combined DNA/RNA Molecule: Synthetic oligonucleotide
gcuauauuuacaugcuacuaaautt

SEQ ID NO: 3185 - DNA, 25 bp, Artificial Sequence
  Description of Artificial Sequence: Synthetic oligonucleotide
  Description of Combined DNA/RNA Molecule: Synthetic oligonucleotide
cuauauuuacaugcuacuaaauutt

SEQ ID NO: 3186 - DNA, 25 bp, Artificial Sequence
  Description of Artificial Sequence: Synthetic oligonucleotide
  Description of Combined DNA/RNA Molecule: Synthetic oligonucleotide
uauauuuacaugcuacuaaauuutt

SEQ ID NO: 3187 - DNA, 25 bp, Artificial Sequence
  Description of Artificial Sequence: Synthetic oligonucleotide
  Description of Combined DNA/RNA Molecule: Synthetic oligonucleotide
auauuuacaugcuacuaaauuuuta

SEQ ID NO: 3188 - DNA, 25 bp, Artificial Sequence
  Description of Artificial Sequence: Synthetic oligonucleotide
  Description of Combined DNA/RNA Molecule: Synthetic oligonucleotide
uacaugcuacuaaauuuuuauaata

SEQ ID NO: 3189 - RNA, 25 nt, Artificial Sequence
  Description of Artificial Sequence: Synthetic oligonucleotide
uacuaaauuuuuauaauaauugaaa

SEQ ID NO: 3190 - RNA, 25 nt, Artificial Sequence
  Description of Artificial Sequence: Synthetic oligonucleotide
acuaaauuuuuauaauaauugaaaa

SEQ ID NO: 3191 - RNA, 25 nt, Artificial Sequence
  Description of Artificial Sequence: Synthetic oligonucleotide
uaaauuuuuauaauaauugaaaaga

SEQ ID NO: 3192 - DNA, 25 bp, Artificial Sequence
  Description of Artificial Sequence: Synthetic oligonucleotide
  Description of Combined DNA/RNA Molecule: Synthetic oligonucleotide
aaauuuuuauaauaauugaaaagat

SEQ ID NO: 3193 - DNA, 25 bp, Artificial Sequence
  Description of Artificial Sequence: Synthetic oligonucleotide
  Description of Combined DNA/RNA Molecule: Synthetic oligonucleotide
aauuuuuauaauaauugaaaagatt

SEQ ID NO: 3194 - DNA, 25 bp, Artificial Sequence
  Description of Artificial Sequence: Synthetic oligonucleotide
  Description of Combined DNA/RNA Molecule: Synthetic oligonucleotide
auuuuuauaauaauugaaaagautt

SEQ ID NO: 3195 - DNA, 25 bp, Artificial Sequence
  Description of Artificial Sequence: Synthetic oligonucleotide
  Description of Combined DNA/RNA Molecule: Synthetic oligonucleotide
uuuuuauaauaauugaaaagauutt

SEQ ID NO: 3196 - DNA, 25 bp, Artificial Sequence
  Description of Artificial Sequence: Synthetic oligonucleotide
  Description of Combined DNA/RNA Molecule: Synthetic oligonucleotide
uuuuauaauaauugaaaagauuuta

SEQ ID NO: 3197 - RNA, 25 nt, Artificial Sequence
  Description of Artificial Sequence: Synthetic oligonucleotide
uuuauaauaauugaaaagauuuuaa

SEQ ID NO: 3198 - RNA, 25 nt, Artificial Sequence
  Description of Artificial Sequence: Synthetic oligonucleotide
uuauaauaauugaaaagauuuuaac

SEQ ID NO: 3199 - RNA, 25 nt, Artificial Sequence
  Description of Artificial Sequence: Synthetic oligonucleotide
uauaauaauugaaaagauuuuaaca

SEQ ID NO: 3200 - DNA, 25 bp, Artificial Sequence
  Description of Artificial Sequence: Synthetic oligonucleotide
  Description of Combined DNA/RNA Molecule: Synthetic oligonucleotide
auaauugaaaagauuuuaacaagta

SEQ ID NO: 3201 - DNA, 25 bp, Artificial Sequence
  Description of Artificial Sequence: Synthetic oligonucleotide
  Description of Combined DNA/RNA Molecule: Synthetic oligonucleotide
uaauugaaaagauuuuaacaaguat

SEQ ID NO: 3202 - RNA, 25 nt, Artificial Sequence
  Description of Artificial Sequence: Synthetic oligonucleotide
auugaaaagauuuuaacaaguauaa

SEQ ID NO: 3203 - RNA, 25 nt, Artificial Sequence
  Description of Artificial Sequence: Synthetic oligonucleotide
uugaaaagauuuuaacaaguauaaa

SEQ ID NO: 3204 - RNA, 25 nt, Artificial Sequence
  Description of Artificial Sequence: Synthetic oligonucleotide
ugaaaagauuuuaacaaguauaaaa

SEQ ID NO: 3205 - RNA, 25 nt, Artificial Sequence
  Description of Artificial Sequence: Synthetic oligonucleotide
gaaaagauuuuaacaaguauaaaaa

SEQ ID NO: 3206 - RNA, 25 nt, Artificial Sequence
  Description of Artificial Sequence: Synthetic oligonucleotide
aaaagauuuuaacaaguauaaaaaa

SEQ ID NO: 3207 - DNA, 25 bp, Artificial Sequence
  Description of Artificial Sequence: Synthetic oligonucleotide
  Description of Combined DNA/RNA Molecule: Synthetic oligonucleotide
aaagauuuuaacaaguauaaaaaat

SEQ ID NO: 3208 - DNA, 25 bp, Artificial Sequence
  Description of Artificial Sequence: Synthetic oligonucleotide
  Description of Combined DNA/RNA Molecule: Synthetic oligonucleotide
aagauuuuaacaaguauaaaaaatt

SEQ ID NO: 3209 - DNA, 25 bp, Artificial Sequence
  Description of Artificial Sequence: Synthetic oligonucleotide
  Description of Combined DNA/RNA Molecule: Synthetic oligonucleotide
agauuuuaacaaguauaaaaaautc

SEQ ID NO: 3210 - DNA, 25 bp, Artificial Sequence
  Description of Artificial Sequence: Synthetic oligonucleotide
  Description of Combined DNA/RNA Molecule: Synthetic oligonucleotide
gauuuuaacaaguauaaaaaauuct

SEQ ID NO: 3211 - RNA, 25 nt, Artificial Sequence
  Description of Artificial Sequence: Synthetic oligonucleotide
acaaguauaaaaaauucucauagga

SEQ ID NO: 3212 - RNA, 25 nt, Artificial Sequence
  Description of Artificial Sequence: Synthetic oligonucleotide
caaguauaaaaaauucucauaggaa

SEQ ID NO: 3213 - DNA, 25 bp, Artificial Sequence
  Description of Artificial Sequence: Synthetic oligonucleotide
  Description of Combined DNA/RNA Molecule: Synthetic oligonucleotide
aaguauaaaaaauucucauaggaat

SEQ ID NO: 3214 - DNA, 25 bp, Artificial Sequence
  Description of Artificial Sequence: Synthetic oligonucleotide
  Description of Combined DNA/RNA Molecule: Synthetic oligonucleotide
aguauaaaaaauucucauaggaatt

SEQ ID NO: 3215 - DNA, 25 bp, Artificial Sequence
  Description of Artificial Sequence: Synthetic oligonucleotide
  Description of Combined DNA/RNA Molecule: Synthetic oligonucleotide
guauaaaaaauucucauaggaauta

SEQ ID NO: 3216 - RNA, 25 nt, Artificial Sequence
  Description of Artificial Sequence: Synthetic oligonucleotide
uauaaaaaauucucauaggaauuaa

SEQ ID NO: 3217 - RNA, 25 nt, Artificial Sequence
  Description of Artificial Sequence: Synthetic oligonucleotide
auaaaaaauucucauaggaauuaaa

SEQ ID NO: 3218 - DNA, 25 bp, Artificial Sequence
  Description of Artificial Sequence: Synthetic oligonucleotide
  Description of Combined DNA/RNA Molecule: Synthetic oligonucleotide
uaaaaaauucucauaggaauuaaat

SEQ ID NO: 3219 - DNA, 25 bp, Artificial Sequence
  Description of Artificial Sequence: Synthetic oligonucleotide
  Description of Combined DNA/RNA Molecule: Synthetic oligonucleotide
aaaaauucucauaggaauuaaaugt

SEQ ID NO: 3220 - DNA, 25 bp, Artificial Sequence
  Description of Artificial Sequence: Synthetic oligonucleotide
  Description of Combined DNA/RNA Molecule: Synthetic oligonucleotide
aaaauucucauaggaauuaaaugta

SEQ ID NO: 3221 - DNA, 25 bp, Artificial Sequence
  Description of Artificial Sequence: Synthetic oligonucleotide
  Description of Combined DNA/RNA Molecule: Synthetic oligonucleotide
cucuuucauaguauaacuuuaaatc

SEQ ID NO: 3222 - DNA, 25 bp, Artificial Sequence
  Description of Artificial Sequence: Synthetic oligonucleotide
  Description of Combined DNA/RNA Molecule: Synthetic oligonucleotide
ucauaguauaacuuuaaaucuuutc

SEQ ID NO: 3223 - DNA, 25 bp, Artificial Sequence
  Description of Artificial Sequence: Synthetic oligonucleotide
  Description of Combined DNA/RNA Molecule: Synthetic oligonucleotide
cauaguauaacuuuaaaucuuuuct

SEQ ID NO: 3224 - DNA, 25 bp, Artificial Sequence
  Description of Artificial Sequence: Synthetic oligonucleotide
  Description of Combined DNA/RNA Molecule: Synthetic oligonucleotide
uuuaaaucuuuucuucaacuugagt

SEQ ID NO: 3225 - DNA, 25 bp, Artificial Sequence
  Description of Artificial Sequence: Synthetic oligonucleotide
  Description of Combined DNA/RNA Molecule: Synthetic oligonucleotide
uuaaaucuuuucuucaacuugagtc

SEQ ID NO: 3226 - DNA, 25 bp, Artificial Sequence
  Description of Artificial Sequence: Synthetic oligonucleotide
  Description of Combined DNA/RNA Molecule: Synthetic oligonucleotide
aacuugagucuuugaagauaguutt

SEQ ID NO: 3227 - RNA, 25 nt, Artificial Sequence
  Description of Artificial Sequence: Synthetic oligonucleotide
cuugagucuuugaagauaguuuuaa

SEQ ID NO: 3228 - DNA, 25 bp, Artificial Sequence
  Description of Artificial Sequence: Synthetic oligonucleotide
  Description of Combined DNA/RNA Molecule: Synthetic oligonucleotide
uugagucuuugaagauaguuuuaat

SEQ ID NO: 3229 - RNA, 25 nt, Artificial Sequence
  Description of Artificial Sequence: Synthetic oligonucleotide
aagauaguuuuaauucugcuuguga

SEQ ID NO: 3230 - RNA, 25 nt, Artificial Sequence
  Description of Artificial Sequence: Synthetic oligonucleotide
agauaguuuuaauucugcuugugac

SEQ ID NO: 3231 - RNA, 25 nt, Artificial Sequence
  Description of Artificial Sequence: Synthetic oligonucleotide
gauaguuuuaauucugcuugugaca

SEQ ID NO: 3232 - DNA, 25 bp, Artificial Sequence
  Description of Artificial Sequence: Synthetic oligonucleotide
  Description of Combined DNA/RNA Molecule: Synthetic oligonucleotide
ugcuugugacauuaaaagauuautt

SEQ ID NO: 3233 - RNA, 25 nt, Artificial Sequence
  Description of Artificial Sequence: Synthetic oligonucleotide
agcauugcuuuuguuucuuaagaaa

SEQ ID NO: 3234 - RNA, 25 nt, Artificial Sequence
  Description of Artificial Sequence: Synthetic oligonucleotide
gcauugcuuuuguuucuuaagaaaa

SEQ ID NO: 3235 - DNA, 25 bp, Artificial Sequence
  Description of Artificial Sequence: Synthetic oligonucleotide
  Description of Combined DNA/RNA Molecule: Synthetic oligonucleotide
cuuuuguuucuuaagaaaacaaact

SEQ ID NO: 3236 - DNA, 25 bp, Artificial Sequence
  Description of Artificial Sequence: Synthetic oligonucleotide
  Description of Combined DNA/RNA Molecule: Synthetic oligonucleotide
uucuuaagaaaacaaacucuuuutt

SEQ ID NO: 3237 - DNA, 25 bp, Artificial Sequence
  Description of Artificial Sequence: Synthetic oligonucleotide
  Description of Combined DNA/RNA Molecule: Synthetic oligonucleotide
ucuuaagaaaacaaacucuuuuuta

SEQ ID NO: 3238 - RNA, 25 nt, Artificial Sequence
  Description of Artificial Sequence: Synthetic oligonucleotide
cuuaagaaaacaaacucuuuuuuaa

SEQ ID NO: 3239 - RNA, 25 nt, Artificial Sequence
  Description of Artificial Sequence: Synthetic oligonucleotide
uuaagaaaacaaacucuuuuuuaaa

SEQ ID NO: 3240 - RNA, 25 nt, Artificial Sequence
  Description of Artificial Sequence: Synthetic oligonucleotide
uaagaaaacaaacucuuuuuuaaaa

SEQ ID NO: 3241 - RNA, 25 nt, Artificial Sequence
  Description of Artificial Sequence: Synthetic oligonucleotide
aagaaaacaaacucuuuuuuaaaaa

SEQ ID NO: 3242 - DNA, 25 bp, Artificial Sequence
  Description of Artificial Sequence: Synthetic oligonucleotide
  Description of Combined DNA/RNA Molecule: Synthetic oligonucleotide
agaaaacaaacucuuuuuuaaaaat

SEQ ID NO: 3243 - DNA, 25 bp, Artificial Sequence
  Description of Artificial Sequence: Synthetic oligonucleotide
  Description of Combined DNA/RNA Molecule: Synthetic oligonucleotide
aacaaacucuuuuuuaaaaauuact

SEQ ID NO: 3244 - RNA, 25 nt, Artificial Sequence
  Description of Artificial Sequence: Synthetic oligonucleotide
cucuuuuuuaaaaauuacuuuuaaa

SEQ ID NO: 3245 - DNA, 25 bp, Artificial Sequence
  Description of Artificial Sequence: Synthetic oligonucleotide
  Description of Combined DNA/RNA Molecule: Synthetic oligonucleotide
ucuuuuuuaaaaauuacuuuuaaat

SEQ ID NO: 3246 - DNA, 25 bp, Artificial Sequence
  Description of Artificial Sequence: Synthetic oligonucleotide
  Description of Combined DNA/RNA Molecule: Synthetic oligonucleotide
cuuuuuuaaaaauuacuuuuaaata

SEQ ID NO: 3247 - DNA, 25 bp, Artificial Sequence
  Description of Artificial Sequence: Synthetic oligonucleotide
  Description of Combined DNA/RNA Molecule: Synthetic oligonucleotide
uuuuuuaaaaauuacuuuuaaauat

SEQ ID NO: 3248 - DNA, 25 bp, Artificial Sequence
  Description of Artificial Sequence: Synthetic oligonucleotide
  Description of Combined DNA/RNA Molecule: Synthetic oligonucleotide
uuuuuaaaaauuacuuuuaaauatt

SEQ ID NO: 3249 - DNA, 25 bp, Artificial Sequence
  Description of Artificial Sequence: Synthetic oligonucleotide
  Description of Combined DNA/RNA Molecule: Synthetic oligonucleotide
uuuuaaaaauuacuuuuaaauauta

SEQ ID NO: 3250 - RNA, 25 nt, Artificial Sequence
  Description of Artificial Sequence: Synthetic oligonucleotide
uuuaaaaauuacuuuuaaauauuaa

SEQ ID NO: 3251 - RNA, 25 nt, Artificial Sequence
  Description of Artificial Sequence: Synthetic oligonucleotide
uuaaaaauuacuuuuaaauauuaac

SEQ ID NO: 3252 - DNA, 25 bp, Artificial Sequence
  Description of Artificial Sequence: Synthetic oligonucleotide
  Description of Combined DNA/RNA Molecule: Synthetic oligonucleotide
uaaaaauuacuuuuaaauauuaact

SEQ ID NO: 3253 - DNA, 25 bp, Artificial Sequence
  Description of Artificial Sequence: Synthetic oligonucleotide
  Description of Combined DNA/RNA Molecule: Synthetic oligonucleotide
uacuuuuaaauauuaacucaaaagt

SEQ ID NO: 3254 - DNA, 25 bp, Artificial Sequence
  Description of Artificial Sequence: Synthetic oligonucleotide
  Description of Combined DNA/RNA Molecule: Synthetic oligonucleotide
acuuuuaaauauuaacucaaaagtt

SEQ ID NO: 3255 - RNA, 25 nt, Artificial Sequence
  Description of Artificial Sequence: Synthetic oligonucleotide
uuuuaaauauuaacucaaaaguuga

SEQ ID NO: 3256 - RNA, 25 nt, Artificial Sequence
  Description of Artificial Sequence: Synthetic oligonucleotide
uuaaauauuaacucaaaaguugaga

SEQ ID NO: 3257 - DNA, 25 bp, Artificial Sequence
  Description of Artificial Sequence: Synthetic oligonucleotide
  Description of Combined DNA/RNA Molecule: Synthetic oligonucleotide
uaaauauuaacucaaaaguugagat

SEQ ID NO: 3258 - DNA, 25 bp, Artificial Sequence
  Description of Artificial Sequence: Synthetic oligonucleotide
  Description of Combined DNA/RNA Molecule: Synthetic oligonucleotide
aaauauuaacucaaaaguugagatt

SEQ ID NO: 3259 - DNA, 25 bp, Artificial Sequence
  Description of Artificial Sequence: Synthetic oligonucleotide
  Description of Combined DNA/RNA Molecule: Synthetic oligonucleotide
aauauuaacucaaaaguugagautt

SEQ ID NO: 3260 - DNA, 25 bp, Artificial Sequence
  Description of Artificial Sequence: Synthetic oligonucleotide
  Description of Combined DNA/RNA Molecule: Synthetic oligonucleotide
ggugugccaagacauuaauuuuutt

SEQ ID NO: 3261 - RNA, 25 nt, Artificial Sequence
  Description of Artificial Sequence: Synthetic oligonucleotide
gccaagacauuaauuuuuuuuuuaa

SEQ ID NO: 3262 - RNA, 25 nt, Artificial Sequence
  Description of Artificial Sequence: Synthetic oligonucleotide
ccaagacauuaauuuuuuuuuuaaa

SEQ ID NO: 3263 - RNA, 25 nt, Artificial Sequence
  Description of Artificial Sequence: Synthetic oligonucleotide
cauuaauuuuuuuuuuaaacaauga

SEQ ID NO: 3264 - RNA, 25 nt, Artificial Sequence
  Description of Artificial Sequence: Synthetic oligonucleotide
auuaauuuuuuuuuuaaacaaugaa

SEQ ID NO: 3265 - DNA, 25 bp, Artificial Sequence
  Description of Artificial Sequence: Synthetic oligonucleotide
  Description of Combined DNA/RNA Molecule: Synthetic oligonucleotide
uaauuuuuuuuuuaaacaaugaagt

SEQ ID NO: 3266 - RNA, 25 nt, Artificial Sequence
  Description of Artificial Sequence: Synthetic oligonucleotide
auuuuuuuuuuaaacaaugaaguga

SEQ ID NO: 3267 - RNA, 25 nt, Artificial Sequence
  Description of Artificial Sequence: Synthetic oligonucleotide
uuuuuuuuuuaaacaaugaagugaa

SEQ ID NO: 3268 - RNA, 25 nt, Artificial Sequence
  Description of Artificial Sequence: Synthetic oligonucleotide
uuuuuuuuuaaacaaugaagugaaa

SEQ ID NO: 3269 - RNA, 25 nt, Artificial Sequence
  Description of Artificial Sequence: Synthetic oligonucleotide
uuuuuuuuaaacaaugaagugaaaa

SEQ ID NO: 3270 - RNA, 25 nt, Artificial Sequence
  Description of Artificial Sequence: Synthetic oligonucleotide
uuuuuuuaaacaaugaagugaaaaa

SEQ ID NO: 3271 - DNA, 25 bp, Artificial Sequence
  Description of Artificial Sequence: Synthetic oligonucleotide
  Description of Combined DNA/RNA Molecule: Synthetic oligonucleotide
uuuuuaaacaaugaagugaaaaagt

SEQ ID NO: 3272 - DNA, 25 bp, Artificial Sequence
  Description of Artificial Sequence: Synthetic oligonucleotide
  Description of Combined DNA/RNA Molecule: Synthetic oligonucleotide
uuuuaaacaaugaagugaaaaagtt

SEQ ID NO: 3273 - DNA, 25 bp, Artificial Sequence
  Description of Artificial Sequence: Synthetic oligonucleotide
  Description of Combined DNA/RNA Molecule: Synthetic oligonucleotide
uuuaaacaaugaagugaaaaagutt

SEQ ID NO: 3274 - DNA, 25 bp, Artificial Sequence
  Description of Artificial Sequence: Synthetic oligonucleotide
  Description of Combined DNA/RNA Molecule: Synthetic oligonucleotide
augaagugaaaaaguuuuacaauct

SEQ ID NO: 3275 - DNA, 25 bp, Artificial Sequence
  Description of Artificial Sequence: Synthetic oligonucleotide
  Description of Combined DNA/RNA Molecule: Synthetic oligonucleotide
ugaaaaaguuuuacaaucucuaggt

SEQ ID NO: 3276 - DNA, 25 bp, Artificial Sequence
  Description of Artificial Sequence: Synthetic oligonucleotide
  Description of Combined DNA/RNA Molecule: Synthetic oligonucleotide
gaaaaaguuuuacaaucucuaggtt

SEQ ID NO: 3277 - DNA, 25 bp, Artificial Sequence
  Description of Artificial Sequence: Synthetic oligonucleotide
  Description of Combined DNA/RNA Molecule: Synthetic oligonucleotide
aaaaaguuuuacaaucucuaggutt

SEQ ID NO: 3278 - RNA, 25 nt, Artificial Sequence
  Description of Artificial Sequence: Synthetic oligonucleotide
acugguuaaauuaacauugcauaaa

SEQ ID NO: 3279 - RNA, 25 nt, Artificial Sequence
  Description of Artificial Sequence: Synthetic oligonucleotide
cugguuaaauuaacauugcauaaac

SEQ ID NO: 3280 - RNA, 25 nt, Artificial Sequence
  Description of Artificial Sequence: Synthetic oligonucleotide
ugguuaaauuaacauugcauaaaca

SEQ ID NO: 3281 - DNA, 25 bp, Artificial Sequence
  Description of Artificial Sequence: Synthetic oligonucleotide
  Description of Combined DNA/RNA Molecule: Synthetic oligonucleotide
acauugcauaaacacuuuucaagtc

SEQ ID NO: 3282 - DNA, 25 bp, Artificial Sequence
  Description of Artificial Sequence: Synthetic oligonucleotide
  Description of Combined DNA/RNA Molecule: Synthetic oligonucleotide
ucaagucugauccauauuuaauaat

SEQ ID NO: 3283 - DNA, 25 bp, Artificial Sequence
  Description of Artificial Sequence: Synthetic oligonucleotide
  Description of Combined DNA/RNA Molecule: Synthetic oligonucleotide
uccauauuuaauaaugcuuuaaaat

SEQ ID NO: 3284 - DNA, 25 bp, Artificial Sequence
  Description of Artificial Sequence: Synthetic oligonucleotide
  Description of Combined DNA/RNA Molecule: Synthetic oligonucleotide
ccauauuuaauaaugcuuuaaaata

SEQ ID NO: 3285 - RNA, 25 nt, Artificial Sequence
  Description of Artificial Sequence: Synthetic oligonucleotide
cauauuuaauaaugcuuuaaaauaa

SEQ ID NO: 3286 - RNA, 25 nt, Artificial Sequence
  Description of Artificial Sequence: Synthetic oligonucleotide
auauuuaauaaugcuuuaaaauaaa

SEQ ID NO: 3287 - RNA, 25 nt, Artificial Sequence
  Description of Artificial Sequence: Synthetic oligonucleotide
uauuuaauaaugcuuuaaaauaaaa

SEQ ID NO: 3288 - RNA, 25 nt, Artificial Sequence
  Description of Artificial Sequence: Synthetic oligonucleotide
auuuaauaaugcuuuaaaauaaaaa

SEQ ID NO: 3289 - DNA, 25 bp, Artificial Sequence
  Description of Artificial Sequence: Synthetic oligonucleotide
  Description of Combined DNA/RNA Molecule: Synthetic oligonucleotide
uuaauaaugcuuuaaaauaaaaata

SEQ ID NO: 3290 - RNA, 25 nt, Artificial Sequence
  Description of Artificial Sequence: Synthetic oligonucleotide
uaauaaugcuuuaaaauaaaaauaa

SEQ ID NO: 3291 - RNA, 25 nt, Artificial Sequence
  Description of Artificial Sequence: Synthetic oligonucleotide
aauaaugcuuuaaaauaaaaauaaa

SEQ ID NO: 3292 - RNA, 25 nt, Artificial Sequence
  Description of Artificial Sequence: Synthetic oligonucleotide
auaaugcuuuaaaauaaaaauaaaa

SEQ ID NO: 3293 - RNA, 25 nt, Artificial Sequence
  Description of Artificial Sequence: Synthetic oligonucleotide
uuuaaaauaaaaauaaaaacaaucc

SEQ ID NO: 3294 - RNA, 25 nt, Artificial Sequence
  Description of Artificial Sequence: Synthetic oligonucleotide
auaaaaauaaaaacaauccuuuuga

SEQ ID NO: 3295 - DNA, 25 bp, Artificial Sequence
  Description of Artificial Sequence: Synthetic oligonucleotide
  Description of Combined DNA/RNA Molecule: Synthetic oligonucleotide
uaaaaauaaaaacaauccuuuugat

SEQ ID NO: 3296 - DNA, 25 bp, Artificial Sequence
  Description of Artificial Sequence: Synthetic oligonucleotide
  Description of Combined DNA/RNA Molecule: Synthetic oligonucleotide
aaaaauaaaaacaauccuuuugata

SEQ ID NO: 3297 - RNA, 25 nt, Artificial Sequence
  Description of Artificial Sequence: Synthetic oligonucleotide
aaaauaaaaacaauccuuuugauaa

SEQ ID NO: 3298 - RNA, 25 nt, Artificial Sequence
  Description of Artificial Sequence: Synthetic oligonucleotide
aaauaaaaacaauccuuuugauaaa

SEQ ID NO: 3299 - DNA, 25 bp, Artificial Sequence
  Description of Artificial Sequence: Synthetic oligonucleotide
  Description of Combined DNA/RNA Molecule: Synthetic oligonucleotide
aauaaaaacaauccuuuugauaaat

SEQ ID NO: 3300 - DNA, 25 bp, Artificial Sequence
  Description of Artificial Sequence: Synthetic oligonucleotide
  Description of Combined DNA/RNA Molecule: Synthetic oligonucleotide
auaaaaacaauccuuuugauaaatt

SEQ ID NO: 3301 - DNA, 25 bp, Artificial Sequence
  Description of Artificial Sequence: Synthetic oligonucleotide
  Description of Combined DNA/RNA Molecule: Synthetic oligonucleotide
uaaaaacaauccuuuugauaaautt

SEQ ID NO: 3302 - RNA, 25 nt, Artificial Sequence
  Description of Artificial Sequence: Synthetic oligonucleotide
aacaauccuuuugauaaauuuaaaa

SEQ ID NO: 3303 - DNA, 25 bp, Artificial Sequence
  Description of Artificial Sequence: Synthetic oligonucleotide
  Description of Combined DNA/RNA Molecule: Synthetic oligonucleotide
uccuuuugauaaauuuaaaauguta

SEQ ID NO: 3304 - RNA, 25 nt, Artificial Sequence
  Description of Artificial Sequence: Synthetic oligonucleotide
ccuuuugauaaauuuaaaauguuac

SEQ ID NO: 3305 - DNA, 25 bp, Artificial Sequence
  Description of Artificial Sequence: Synthetic oligonucleotide
  Description of Combined DNA/RNA Molecule: Synthetic oligonucleotide
cuuuugauaaauuuaaaauguuact

SEQ ID NO: 3306 - DNA, 25 bp, Artificial Sequence
  Description of Artificial Sequence: Synthetic oligonucleotide
  Description of Combined DNA/RNA Molecule: Synthetic oligonucleotide
ugauaaauuuaaaauguuacuuatt

SEQ ID NO: 3307 - DNA, 25 bp, Artificial Sequence
  Description of Artificial Sequence: Synthetic oligonucleotide
  Description of Combined DNA/RNA Molecule: Synthetic oligonucleotide
gauaaauuuaaaauguuacuuautt

SEQ ID NO: 3308 - DNA, 25 bp, Artificial Sequence
  Description of Artificial Sequence: Synthetic oligonucleotide
  Description of Combined DNA/RNA Molecule: Synthetic oligonucleotide
auaaauuuaaaauguuacuuauutt

SEQ ID NO: 3309 - DNA, 25 bp, Artificial Sequence
  Description of Artificial Sequence: Synthetic oligonucleotide
  Description of Combined DNA/RNA Molecule: Synthetic oligonucleotide
uaaauuuaaaauguuacuuauuuta

SEQ ID NO: 3310 - RNA, 25 nt, Artificial Sequence
  Description of Artificial Sequence: Synthetic oligonucleotide
aaauuuaaaauguuacuuauuuuaa

SEQ ID NO: 3311 - RNA, 25 nt, Artificial Sequence
  Description of Artificial Sequence: Synthetic oligonucleotide
aauuuaaaauguuacuuauuuuaaa

SEQ ID NO: 3312 - DNA, 25 bp, Artificial Sequence
  Description of Artificial Sequence: Synthetic oligonucleotide
  Description of Combined DNA/RNA Molecule: Synthetic oligonucleotide
uuuaaaauguuacuuauuuuaaaat

SEQ ID NO: 3313 - DNA, 25 bp, Artificial Sequence
  Description of Artificial Sequence: Synthetic oligonucleotide
  Description of Combined DNA/RNA Molecule: Synthetic oligonucleotide
uuaaaauguuacuuauuuuaaaata

SEQ ID NO: 3314 - RNA, 25 nt, Artificial Sequence
  Description of Artificial Sequence: Synthetic oligonucleotide
uaaaauguuacuuauuuuaaaauaa

SEQ ID NO: 3315 - RNA, 25 nt, Artificial Sequence
  Description of Artificial Sequence: Synthetic oligonucleotide
aaaauguuacuuauuuuaaaauaaa

SEQ ID NO: 3316 - DNA, 25 bp, Artificial Sequence
  Description of Artificial Sequence: Synthetic oligonucleotide
  Description of Combined DNA/RNA Molecule: Synthetic oligonucleotide
aaauguuacuuauuuuaaaauaaat

SEQ ID NO: 3317 - RNA, 25 nt, Artificial Sequence
  Description of Artificial Sequence: Synthetic oligonucleotide
auguuacuuauuuuaaaauaaauga

SEQ ID NO: 3318 - RNA, 25 nt, Artificial Sequence
  Description of Artificial Sequence: Synthetic oligonucleotide
acuuauuuuaaaauaaaugaaguga

SEQ ID NO: 3319 - RNA, 25 nt, Artificial Sequence
  Description of Artificial Sequence: Synthetic oligonucleotide
uuauuuuaaaauaaaugaagugaga

SEQ ID NO: 3320 - DNA, 25 bp, Artificial Sequence
  Description of Artificial Sequence: Synthetic oligonucleotide
  Description of Combined DNA/RNA Molecule: Synthetic oligonucleotide
uauuuuaaaauaaaugaagugagat

SEQ ID NO: 3321 - RNA, 25 nt, Artificial Sequence
  Description of Artificial Sequence: Synthetic oligonucleotide
uuuaaaauaaaugaagugagauggc

SEQ ID NO: 3322 - RNA, 25 nt, Artificial Sequence
  Description of Artificial Sequence: Synthetic oligonucleotide
uuaaaauaaaugaagugagauggca

SEQ ID NO: 3323 - DNA, 25 bp, Artificial Sequence
  Description of Artificial Sequence: Synthetic oligonucleotide
  Description of Combined DNA/RNA Molecule: Synthetic oligonucleotide
uccauuucuucauguuaaaagaagt

SEQ ID NO: 3324 - DNA, 25 bp, Artificial Sequence
  Description of Artificial Sequence: Synthetic oligonucleotide
  Description of Combined DNA/RNA Molecule: Synthetic oligonucleotide
ccauuucuucauguuaaaagaagtc

SEQ ID NO: 3325 - DNA, 25 bp, Artificial Sequence
  Description of Artificial Sequence: Synthetic oligonucleotide
  Description of Combined DNA/RNA Molecule: Synthetic oligonucleotide
cucaaacucuuaguuuuuuuuuutt

SEQ ID NO: 3326 - DNA, 25 bp, Artificial Sequence
  Description of Artificial Sequence: Synthetic oligonucleotide
  Description of Combined DNA/RNA Molecule: Synthetic oligonucleotide
uaguuuuuuuuuuuuacaacuaugt

SEQ ID NO: 3327 - DNA, 25 bp, Artificial Sequence
  Description of Artificial Sequence: Synthetic oligonucleotide
  Description of Combined DNA/RNA Molecule: Synthetic oligonucleotide
aguuuuuuuuuuuuacaacuaugta

SEQ ID NO: 3328 - RNA, 25 nt, Artificial Sequence
  Description of Artificial Sequence: Synthetic oligonucleotide
guuuuuuuuuuuuacaacuauguaa

SEQ ID NO: 3329 - DNA, 25 bp, Artificial Sequence
  Description of Artificial Sequence: Synthetic oligonucleotide
  Description of Combined DNA/RNA Molecule: Synthetic oligonucleotide
uuuuuuuuuuuuacaacuauguaat

SEQ ID NO: 3330 - DNA, 25 bp, Artificial Sequence
  Description of Artificial Sequence: Synthetic oligonucleotide
  Description of Combined DNA/RNA Molecule: Synthetic oligonucleotide
uuuuuuuuuuuacaacuauguaatt

SEQ ID NO: 3331 - DNA, 25 bp, Artificial Sequence
  Description of Artificial Sequence: Synthetic oligonucleotide
  Description of Combined DNA/RNA Molecule: Synthetic oligonucleotide
uuuuuuuuuuacaacuauguaautt

SEQ ID NO: 3332 - DNA, 25 bp, Artificial Sequence
  Description of Artificial Sequence: Synthetic oligonucleotide
  Description of Combined DNA/RNA Molecule: Synthetic oligonucleotide
uuuuuuuuuacaacuauguaauuta

SEQ ID NO: 3333 - DNA, 25 bp, Artificial Sequence
  Description of Artificial Sequence: Synthetic oligonucleotide
  Description of Combined DNA/RNA Molecule: Synthetic oligonucleotide
uuuuuuuuacaacuauguaauuuat

SEQ ID NO: 3334 - DNA, 25 bp, Artificial Sequence
  Description of Artificial Sequence: Synthetic oligonucleotide
  Description of Combined DNA/RNA Molecule: Synthetic oligonucleotide
uuuuuuuacaacuauguaauuuata

SEQ ID NO: 3335 - DNA, 25 bp, Artificial Sequence
  Description of Artificial Sequence: Synthetic oligonucleotide
  Description of Combined DNA/RNA Molecule: Synthetic oligonucleotide
uuuuuuacaacuauguaauuuauat

SEQ ID NO: 3336 - DNA, 25 bp, Artificial Sequence
  Description of Artificial Sequence: Synthetic oligonucleotide
  Description of Combined DNA/RNA Molecule: Synthetic oligonucleotide
uuuuuacaacuauguaauuuauatt

SEQ ID NO: 3337 - DNA, 25 bp, Artificial Sequence
  Description of Artificial Sequence: Synthetic oligonucleotide
  Description of Combined DNA/RNA Molecule: Synthetic oligonucleotide
aacuauguaauuuauauuccauuta

SEQ ID NO: 3338 - RNA, 25 nt, Artificial Sequence
  Description of Artificial Sequence: Synthetic oligonucleotide
acuauguaauuuauauuccauuuac

SEQ ID NO: 3339 - RNA, 25 nt, Artificial Sequence
  Description of Artificial Sequence: Synthetic oligonucleotide
cuauguaauuuauauuccauuuaca

SEQ ID NO: 3340 - RNA, 25 nt, Artificial Sequence
  Description of Artificial Sequence: Synthetic oligonucleotide
aauuuauauuccauuuacauaagga

SEQ ID NO: 3341 - DNA, 25 bp, Artificial Sequence
  Description of Artificial Sequence: Synthetic oligonucleotide
  Description of Combined DNA/RNA Molecule: Synthetic oligonucleotide
auuuauauuccauuuacauaaggat

SEQ ID NO: 3342 - DNA, 25 bp, Artificial Sequence
  Description of Artificial Sequence: Synthetic oligonucleotide
  Description of Combined DNA/RNA Molecule: Synthetic oligonucleotide
uuuauauuccauuuacauaaggata

SEQ ID NO: 3343 - RNA, 25 nt, Artificial Sequence
  Description of Artificial Sequence: Synthetic oligonucleotide
uuauauuccauuuacauaaggauac

SEQ ID NO: 3344 - RNA, 25 nt, Artificial Sequence
  Description of Artificial Sequence: Synthetic oligonucleotide
uacauaaggauacacuuauuuguca

SEQ ID NO: 3345 - DNA, 25 bp, Artificial Sequence
  Description of Artificial Sequence: Synthetic oligonucleotide
  Description of Combined DNA/RNA Molecule: Synthetic oligonucleotide
uaaggauacacuuauuugucaagct

SEQ ID NO: 3346 - DNA, 25 bp, Artificial Sequence
  Description of Artificial Sequence: Synthetic oligonucleotide
  Description of Combined DNA/RNA Molecule: Synthetic oligonucleotide
aucuguaaauuuuuaaccuauguta

SEQ ID NO: 3347 - RNA, 25 nt, Artificial Sequence
  Description of Artificial Sequence: Synthetic oligonucleotide
ucuguaaauuuuuaaccuauguuac

SEQ ID NO: 3348 - RNA, 25 nt, Artificial Sequence
  Description of Artificial Sequence: Synthetic oligonucleotide
cuguaaauuuuuaaccuauguuaca

SEQ ID NO: 3349 - RNA, 25 nt, Artificial Sequence
  Description of Artificial Sequence: Synthetic oligonucleotide
ugcaagaggugaaguuuauauuuga

SEQ ID NO: 3350 - DNA, 25 bp, Artificial Sequence
  Description of Artificial Sequence: Synthetic oligonucleotide
  Description of Combined DNA/RNA Molecule: Synthetic oligonucleotide
caagaggugaaguuuauauuugaat

SEQ ID NO: 3351 - DNA, 25 bp, Artificial Sequence
  Description of Artificial Sequence: Synthetic oligonucleotide
  Description of Combined DNA/RNA Molecule: Synthetic oligonucleotide
aagaggugaaguuuauauuugaata

SEQ ID NO: 3352 - DNA, 25 bp, Artificial Sequence
  Description of Artificial Sequence: Synthetic oligonucleotide
  Description of Combined DNA/RNA Molecule: Synthetic oligonucleotide
gaggugaaguuuauauuugaauatc

SEQ ID NO: 3353 - RNA, 25 nt, Artificial Sequence
  Description of Artificial Sequence: Synthetic oligonucleotide
aggugaaguuuauauuugaauaucc

SEQ ID NO: 3354 - DNA, 25 bp, Artificial Sequence
  Description of Artificial Sequence: Synthetic oligonucleotide
  Description of Combined DNA/RNA Molecule: Synthetic oligonucleotide
aaguuuauauuugaauauccauuct

SEQ ID NO: 3355 - DNA, 25 bp, Artificial Sequence
  Description of Artificial Sequence: Synthetic oligonucleotide
  Description of Combined DNA/RNA Molecule: Synthetic oligonucleotide
acuugaugcaguuuuaauacuugta

SEQ ID NO: 3356 - DNA, 25 bp, Artificial Sequence
  Description of Artificial Sequence: Synthetic oligonucleotide
  Description of Combined DNA/RNA Molecule: Synthetic oligonucleotide
uugaugcaguuuuaauacuuguaat

SEQ ID NO: 3357 - RNA, 25 nt, Artificial Sequence
  Description of Artificial Sequence: Synthetic oligonucleotide
gauuugaccuaaucacuaauuuuca

SEQ ID NO: 3358 - DNA, 25 bp, Artificial Sequence
  Description of Artificial Sequence: Synthetic oligonucleotide
  Description of Combined DNA/RNA Molecule: Synthetic oligonucleotide
accuaaucacuaauuuucagguggt

SEQ ID NO: 3359 - DNA, 25 bp, Artificial Sequence
  Description of Artificial Sequence: Synthetic oligonucleotide
  Description of Combined DNA/RNA Molecule: Synthetic oligonucleotide
caguaggauuuuucaaaccugguat

SEQ ID NO: 3360 - DNA, 25 bp, Artificial Sequence
  Description of Artificial Sequence: Synthetic oligonucleotide
  Description of Combined DNA/RNA Molecule: Synthetic oligonucleotide
aguggaaggagaauuuaauaaagat

SEQ ID NO: 3361 - DNA, 25 bp, Artificial Sequence
  Description of Artificial Sequence: Synthetic oligonucleotide
  Description of Combined DNA/RNA Molecule: Synthetic oligonucleotide
ggaaggagaauuuaauaaagauagt

SEQ ID NO: 3362 - RNA, 25 nt, Artificial Sequence
  Description of Artificial Sequence: Synthetic oligonucleotide
aaggagaauuuaauaaagauagugc

SEQ ID NO: 3363 - DNA, 25 bp, Artificial Sequence
  Description of Artificial Sequence: Synthetic oligonucleotide
  Description of Combined DNA/RNA Molecule: Synthetic oligonucleotide
aggagaauuuaauaaagauagugct

SEQ ID NO: 3364 - RNA, 25 nt, Artificial Sequence
  Description of Artificial Sequence: Synthetic oligonucleotide
gaauuuaauaaagauagugcugaaa

SEQ ID NO: 3365 - RNA, 25 nt, Artificial Sequence
  Description of Artificial Sequence: Synthetic oligonucleotide
uccuuagguaaucuauaacuaggac

SEQ ID NO: 3366 - DNA, 25 bp, Artificial Sequence
  Description of Artificial Sequence: Synthetic oligonucleotide
  Description of Combined DNA/RNA Molecule: Synthetic oligonucleotide
ccuuagguaaucuauaacuaggact

SEQ ID NO: 3367 - DNA, 25 bp, Artificial Sequence
  Description of Artificial Sequence: Synthetic oligonucleotide
  Description of Combined DNA/RNA Molecule: Synthetic oligonucleotide
aacaguaauacauuccauuguuuta

SEQ ID NO: 3368 - DNA, 25 bp, Artificial Sequence
  Description of Artificial Sequence: Synthetic oligonucleotide
  Description of Combined DNA/RNA Molecule: Synthetic oligonucleotide
caguaauacauuccauuguuuuagt

SEQ ID NO: 3369 - DNA, 25 bp, Artificial Sequence
  Description of Artificial Sequence: Synthetic oligonucleotide
  Description of Combined DNA/RNA Molecule: Synthetic oligonucleotide
aguaauacauuccauuguuuuagta

SEQ ID NO: 3370 - RNA, 25 nt, Artificial Sequence
  Description of Artificial Sequence: Synthetic oligonucleotide
guaauacauuccauuguuuuaguaa

SEQ ID NO: 3371 - DNA, 25 bp, Artificial Sequence
  Description of Artificial Sequence: Synthetic oligonucleotide
  Description of Combined DNA/RNA Molecule: Synthetic oligonucleotide
ccauuguuuuaguaaccagaaauct

SEQ ID NO: 3372 - RNA, 25 nt, Artificial Sequence
  Description of Artificial Sequence: Synthetic oligonucleotide
accagaaaucuucaugcaaugaaaa

SEQ ID NO: 3373 - DNA, 25 bp, Artificial Sequence
  Description of Artificial Sequence: Synthetic oligonucleotide
  Description of Combined DNA/RNA Molecule: Synthetic oligonucleotide
uucaugcaaugaaaaauacuuuaat

SEQ ID NO: 3374 - RNA, 25 nt, Artificial Sequence
  Description of Artificial Sequence: Synthetic oligonucleotide
aaugaaaaauacuuuaauucaugaa

SEQ ID NO: 3375 - RNA, 25 nt, Artificial Sequence
  Description of Artificial Sequence: Synthetic oligonucleotide
ugaaaaauacuuuaauucaugaagc

SEQ ID NO: 3376 - DNA, 25 bp, Artificial Sequence
  Description of Artificial Sequence: Synthetic oligonucleotide
  Description of Combined DNA/RNA Molecule: Synthetic oligonucleotide
gaaaaauacuuuaauucaugaagct

SEQ ID NO: 3377 - DNA, 25 bp, Artificial Sequence
  Description of Artificial Sequence: Synthetic oligonucleotide
  Description of Combined DNA/RNA Molecule: Synthetic oligonucleotide
uucaugaagcuuacuuuuuuuuutt

SEQ ID NO: 3378 - DNA, 25 bp, Artificial Sequence
  Description of Artificial Sequence: Synthetic oligonucleotide
  Description of Combined DNA/RNA Molecule: Synthetic oligonucleotide
augaagcuuacuuuuuuuuuuuggt

SEQ ID NO: 3379 - RNA, 25 nt, Artificial Sequence
  Description of Artificial Sequence: Synthetic oligonucleotide
agcuuacuuuuuuuuuuugguguca

SEQ ID NO: 3380 - DNA, 25 bp, Artificial Sequence
  Description of Artificial Sequence: Synthetic oligonucleotide
  Description of Combined DNA/RNA Molecule: Synthetic oligonucleotide
uacuuuuuuuuuuuggugucagagt

SEQ ID NO: 3381 - DNA, 25 bp, Artificial Sequence
  Description of Artificial Sequence: Synthetic oligonucleotide
  Description of Combined DNA/RNA Molecule: Synthetic oligonucleotide
acuuuuuuuuuuuggugucagagtc

SEQ ID NO: 3382 - RNA, 25 nt, Artificial Sequence
  Description of Artificial Sequence: Synthetic oligonucleotide
aacuaauuuuuguauuuuuaggaga

SEQ ID NO: 3383 - RNA, 25 nt, Artificial Sequence
  Description of Artificial Sequence: Synthetic oligonucleotide
uaauuuuuguauuuuuaggagagac

SEQ ID NO: 3384 - DNA, 25 bp, Artificial Sequence
  Description of Artificial Sequence: Synthetic oligonucleotide
  Description of Combined DNA/RNA Molecule: Synthetic oligonucleotide
cucauuuauucagcaaauauuuatt

SEQ ID NO: 3385 - RNA, 25 nt, Artificial Sequence
  Description of Artificial Sequence: Synthetic oligonucleotide
cauuuauucagcaaauauuuauuga

SEQ ID NO: 3386 - DNA, 25 bp, Artificial Sequence
  Description of Artificial Sequence: Synthetic oligonucleotide
  Description of Combined DNA/RNA Molecule: Synthetic oligonucleotide
uuuauucagcaaauauuuauugagt

SEQ ID NO: 3387 - DNA, 25 bp, Artificial Sequence
  Description of Artificial Sequence: Synthetic oligonucleotide
  Description of Combined DNA/RNA Molecule: Synthetic oligonucleotide
uauuuuaguuuugcaaagaaggggt

SEQ ID NO: 3388 - DNA, 25 bp, Artificial Sequence
  Description of Artificial Sequence: Synthetic oligonucleotide
  Description of Combined DNA/RNA Molecule: Synthetic oligonucleotide
cucuauaauuguuuugcuacgautc

SEQ ID NO: 3389 - DNA, 25 bp, Artificial Sequence
  Description of Artificial Sequence: Synthetic oligonucleotide
  Description of Combined DNA/RNA Molecule: Synthetic oligonucleotide
uacuuuauguaaaucacuucauugt

SEQ ID NO: 3390 - DNA, 25 bp, Artificial Sequence
  Description of Artificial Sequence: Synthetic oligonucleotide
  Description of Combined DNA/RNA Molecule: Synthetic oligonucleotide
acuuuauguaaaucacuucauugtt

SEQ ID NO: 3391 - DNA, 25 bp, Artificial Sequence
  Description of Artificial Sequence: Synthetic oligonucleotide
  Description of Combined DNA/RNA Molecule: Synthetic oligonucleotide
cuuuauguaaaucacuucauugutt

SEQ ID NO: 3392 - DNA, 25 bp, Artificial Sequence
  Description of Artificial Sequence: Synthetic oligonucleotide
  Description of Combined DNA/RNA Molecule: Synthetic oligonucleotide
uuuauguaaaucacuucauuguutt

SEQ ID NO: 3393 - DNA, 25 bp, Artificial Sequence
  Description of Artificial Sequence: Synthetic oligonucleotide
  Description of Combined DNA/RNA Molecule: Synthetic oligonucleotide
uuauguaaaucacuucauuguuuta

SEQ ID NO: 3394 - RNA, 25 nt, Artificial Sequence
  Description of Artificial Sequence: Synthetic oligonucleotide
uauguaaaucacuucauuguuuuaa

SEQ ID NO: 3395 - RNA, 25 nt, Artificial Sequence
  Description of Artificial Sequence: Synthetic oligonucleotide
auguaaaucacuucauuguuuuaaa

SEQ ID NO: 3396 - DNA, 25 bp, Artificial Sequence
  Description of Artificial Sequence: Synthetic oligonucleotide
  Description of Combined DNA/RNA Molecule: Synthetic oligonucleotide
auuguuuuaaaggaauaaacuugat

SEQ ID NO: 3397 - DNA, 25 bp, Artificial Sequence
  Description of Artificial Sequence: Synthetic oligonucleotide
  Description of Combined DNA/RNA Molecule: Synthetic oligonucleotide
uuguuuuaaaggaauaaacuugatt

SEQ ID NO: 3398 - DNA, 25 bp, Artificial Sequence
  Description of Artificial Sequence: Synthetic oligonucleotide
  Description of Combined DNA/RNA Molecule: Synthetic oligonucleotide
uuuuaaaggaauaaacuugauuata

SEQ ID NO: 3399 - DNA, 25 bp, Artificial Sequence
  Description of Artificial Sequence: Synthetic oligonucleotide
  Description of Combined DNA/RNA Molecule: Synthetic oligonucleotide
uuuaaaggaauaaacuugauuauat

SEQ ID NO: 3400 - DNA, 25 bp, Artificial Sequence
  Description of Artificial Sequence: Synthetic oligonucleotide
  Description of Combined DNA/RNA Molecule: Synthetic oligonucleotide
uuaaaggaauaaacuugauuauatt

SEQ ID NO: 3401 - DNA, 25 bp, Artificial Sequence
  Description of Artificial Sequence: Synthetic oligonucleotide
  Description of Combined DNA/RNA Molecule: Synthetic oligonucleotide
aaaggaauaaacuugauuauauugt

SEQ ID NO: 3402 - DNA, 25 bp, Artificial Sequence
  Description of Artificial Sequence: Synthetic oligonucleotide
  Description of Combined DNA/RNA Molecule: Synthetic oligonucleotide
aaggaauaaacuugauuauauugtt

SEQ ID NO: 3403 - DNA, 25 bp, Artificial Sequence
  Description of Artificial Sequence: Synthetic oligonucleotide
  Description of Combined DNA/RNA Molecule: Synthetic oligonucleotide
aggaauaaacuugauuauauugutt

SEQ ID NO: 3404 - DNA, 25 bp, Artificial Sequence
  Description of Artificial Sequence: Synthetic oligonucleotide
  Description of Combined DNA/RNA Molecule: Synthetic oligonucleotide
ggaauaaacuugauuauauuguutt

SEQ ID NO: 3405 - DNA, 25 bp, Artificial Sequence
  Description of Artificial Sequence: Synthetic oligonucleotide
  Description of Combined DNA/RNA Molecule: Synthetic oligonucleotide
gaauaaacuugauuauauuguuutt

SEQ ID NO: 3406 - DNA, 25 bp, Artificial Sequence
  Description of Artificial Sequence: Synthetic oligonucleotide
  Description of Combined DNA/RNA Molecule: Synthetic oligonucleotide
aacuugauuauauuguuuuuuuatt

SEQ ID NO: 3407 - DNA, 25 bp, Artificial Sequence
  Description of Artificial Sequence: Synthetic oligonucleotide
  Description of Combined DNA/RNA Molecule: Synthetic oligonucleotide
acuugauuauauuguuuuuuuautt

SEQ ID NO: 3408 - RNA, 25 nt, Artificial Sequence
  Description of Artificial Sequence: Synthetic oligonucleotide
ugauuauauuguuuuuuuauuuggc

SEQ ID NO: 3409 - RNA, 25 nt, Artificial Sequence
  Description of Artificial Sequence: Synthetic oligonucleotide
auauuguuuuuuuauuuggcauaac

SEQ ID NO: 3410 - DNA, 25 bp, Artificial Sequence
  Description of Artificial Sequence: Synthetic oligonucleotide
  Description of Combined DNA/RNA Molecule: Synthetic oligonucleotide
uauuguuuuuuuauuuggcauaact

SEQ ID NO: 3411 - RNA, 25 nt, Artificial Sequence
  Description of Artificial Sequence: Synthetic oligonucleotide
guuuuuuuauuuggcauaacuguga

SEQ ID NO: 3412 - DNA, 25 bp, Artificial Sequence
  Description of Artificial Sequence: Synthetic oligonucleotide
  Description of Combined DNA/RNA Molecule: Synthetic oligonucleotide
uuuuuuuauuuggcauaacugugat

SEQ ID NO: 3413 - RNA, 25 nt, Artificial Sequence
  Description of Artificial Sequence: Synthetic oligonucleotide
gcauaacugugauucuuuuaggaca

SEQ ID NO: 3414 - RNA, 25 nt, Artificial Sequence
  Description of Artificial Sequence: Synthetic oligonucleotide
acugugauucuuuuaggacaauuac

SEQ ID NO: 3415 - DNA, 25 bp, Artificial Sequence
  Description of Artificial Sequence: Synthetic oligonucleotide
  Description of Combined DNA/RNA Molecule: Synthetic oligonucleotide
cugugauucuuuuaggacaauuact

SEQ ID NO: 3416 - RNA, 25 nt, Artificial Sequence
  Description of Artificial Sequence: Synthetic oligonucleotide
gguguaugucagauauucauauuga

SEQ ID NO: 3417 - RNA, 25 nt, Artificial Sequence
  Description of Artificial Sequence: Synthetic oligonucleotide
guguaugucagauauucauauugac

SEQ ID NO: 3418 - DNA, 25 bp, Artificial Sequence
  Description of Artificial Sequence: Synthetic oligonucleotide
  Description of Combined DNA/RNA Molecule: Synthetic oligonucleotide
caaauguguaauauuccaguuuuct

SEQ ID NO: 3419 - RNA, 25 nt, Artificial Sequence
  Description of Artificial Sequence: Synthetic oligonucleotide
cauaaguaauuaaaauauacuuaaa

SEQ ID NO: 3420 - RNA, 25 nt, Artificial Sequence
  Description of Artificial Sequence: Synthetic oligonucleotide
auaaguaauuaaaauauacuuaaaa

SEQ ID NO: 3421 - RNA, 25 nt, Artificial Sequence
  Description of Artificial Sequence: Synthetic oligonucleotide
uaaguaauuaaaauauacuuaaaaa

SEQ ID NO: 3422 - DNA, 25 bp, Artificial Sequence
  Description of Artificial Sequence: Synthetic oligonucleotide
  Description of Combined DNA/RNA Molecule: Synthetic oligonucleotide
aaguaauuaaaauauacuuaaaaat

SEQ ID NO: 3423 - DNA, 25 bp, Artificial Sequence
  Description of Artificial Sequence: Synthetic oligonucleotide
  Description of Combined DNA/RNA Molecule: Synthetic oligonucleotide
aguaauuaaaauauacuuaaaaatt

SEQ ID NO: 3424 - DNA, 25 bp, Artificial Sequence
  Description of Artificial Sequence: Synthetic oligonucleotide
  Description of Combined DNA/RNA Molecule: Synthetic oligonucleotide
guaauuaaaauauacuuaaaaauta

SEQ ID NO: 3425 - RNA, 25 nt, Artificial Sequence
  Description of Artificial Sequence: Synthetic oligonucleotide
uaauuaaaauauacuuaaaaauuaa

SEQ ID NO: 3426 - DNA, 25 bp, Artificial Sequence
  Description of Artificial Sequence: Synthetic oligonucleotide
  Description of Combined DNA/RNA Molecule: Synthetic oligonucleotide
aauuaaaauauacuuaaaaauuaat

SEQ ID NO: 3427 - DNA, 25 bp, Artificial Sequence
  Description of Artificial Sequence: Synthetic oligonucleotide
  Description of Combined DNA/RNA Molecule: Synthetic oligonucleotide
auuaaaauauacuuaaaaauuaata

SEQ ID NO: 3428 - DNA, 25 bp, Artificial Sequence
  Description of Artificial Sequence: Synthetic oligonucleotide
  Description of Combined DNA/RNA Molecule: Synthetic oligonucleotide
uaaaauauacuuaaaaauuaauagt

SEQ ID NO: 3429 - DNA, 25 bp, Artificial Sequence
  Description of Artificial Sequence: Synthetic oligonucleotide
  Description of Combined DNA/RNA Molecule: Synthetic oligonucleotide
aaaauauacuuaaaaauuaauagtt

SEQ ID NO: 3430 - DNA, 25 bp, Artificial Sequence
  Description of Artificial Sequence: Synthetic oligonucleotide
  Description of Combined DNA/RNA Molecule: Synthetic oligonucleotide
aaauauacuuaaaaauuaauagutt

SEQ ID NO: 3431 - DNA, 25 bp, Artificial Sequence
  Description of Artificial Sequence: Synthetic oligonucleotide
  Description of Combined DNA/RNA Molecule: Synthetic oligonucleotide
aauauacuuaaaaauuaauaguutt

SEQ ID NO: 3432 - DNA, 25 bp, Artificial Sequence
  Description of Artificial Sequence: Synthetic oligonucleotide
  Description of Combined DNA/RNA Molecule: Synthetic oligonucleotide
uacuuaaaaauuaauaguuuuauct

SEQ ID NO: 3433 - DNA, 25 bp, Artificial Sequence
  Description of Artificial Sequence: Synthetic oligonucleotide
  Description of Combined DNA/RNA Molecule: Synthetic oligonucleotide
uaaaaauuaauaguuuuaucugggt

SEQ ID NO: 3434 - DNA, 25 bp, Artificial Sequence
  Description of Artificial Sequence: Synthetic oligonucleotide
  Description of Combined DNA/RNA Molecule: Synthetic oligonucleotide
aaaaauuaauaguuuuaucugggta

SEQ ID NO: 3435 - RNA, 25 nt, Artificial Sequence
  Description of Artificial Sequence: Synthetic oligonucleotide
aaaauuaauaguuuuaucuggguac

SEQ ID NO: 3436 - RNA, 25 nt, Artificial Sequence
  Description of Artificial Sequence: Synthetic oligonucleotide
aucuggguacaaauaaacaggugcc

SEQ ID NO: 3437 - DNA, 25 bp, Artificial Sequence
  Description of Artificial Sequence: Synthetic oligonucleotide
  Description of Combined DNA/RNA Molecule: Synthetic oligonucleotide
gacaaggaaacuucuauguaaaaat

SEQ ID NO: 3438 - DNA, 25 bp, Artificial Sequence
  Description of Artificial Sequence: Synthetic oligonucleotide
  Description of Combined DNA/RNA Molecule: Synthetic oligonucleotide
acaaggaaacuucuauguaaaaatc

SEQ ID NO: 3439 - RNA, 25 nt, Artificial Sequence
  Description of Artificial Sequence: Synthetic oligonucleotide
caaggaaacuucuauguaaaaauca

SEQ ID NO: 3440 - DNA, 25 bp, Artificial Sequence
  Description of Artificial Sequence: Synthetic oligonucleotide
  Description of Combined DNA/RNA Molecule: Synthetic oligonucleotide
uucuauguaaaaaucacuaugautt

SEQ ID NO: 3441 - DNA, 25 bp, Artificial Sequence
  Description of Artificial Sequence: Synthetic oligonucleotide
  Description of Combined DNA/RNA Molecule: Synthetic oligonucleotide
ucuauguaaaaaucacuaugauutc

SEQ ID NO: 3442 - DNA, 25 bp, Artificial Sequence
  Description of Artificial Sequence: Synthetic oligonucleotide
  Description of Combined DNA/RNA Molecule: Synthetic oligonucleotide
cuauguaaaaaucacuaugauuuct

SEQ ID NO: 3443 - DNA, 25 bp, Artificial Sequence
  Description of Artificial Sequence: Synthetic oligonucleotide
  Description of Combined DNA/RNA Molecule: Synthetic oligonucleotide
guaaaaaucacuaugauuucugaat

SEQ ID NO: 3444 - DNA, 25 bp, Artificial Sequence
  Description of Artificial Sequence: Synthetic oligonucleotide
  Description of Combined DNA/RNA Molecule: Synthetic oligonucleotide
uaaaaaucacuaugauuucugaatt

SEQ ID NO: 3445 - RNA, 25 nt, Artificial Sequence
  Description of Artificial Sequence: Synthetic oligonucleotide
cuaugauuucugaauugcuauguga

SEQ ID NO: 3446 - RNA, 25 nt, Artificial Sequence
  Description of Artificial Sequence: Synthetic oligonucleotide
uaugauuucugaauugcuaugugaa

SEQ ID NO: 3447 - RNA, 25 nt, Artificial Sequence
  Description of Artificial Sequence: Synthetic oligonucleotide
uaugugaaacuacagaucuuuggaa

SEQ ID NO: 3448 - RNA, 25 nt, Artificial Sequence
  Description of Artificial Sequence: Synthetic oligonucleotide
augugaaacuacagaucuuuggaac

SEQ ID NO: 3449 - RNA, 25 nt, Artificial Sequence
  Description of Artificial Sequence: Synthetic oligonucleotide
aggguguuaagacuuacacaguacc

SEQ ID NO: 3450 - DNA, 25 bp, Artificial Sequence
  Description of Artificial Sequence: Synthetic oligonucleotide
  Description of Combined DNA/RNA Molecule: Synthetic oligonucleotide
uuuaggccucuugaauuuuugaugt

SEQ ID NO: 3451 - RNA, 25 nt, Artificial Sequence
  Description of Artificial Sequence: Synthetic oligonucleotide
ucuugaauuuuugauguagaugggc

SEQ ID NO: 3452 - RNA, 25 nt, Artificial Sequence
  Description of Artificial Sequence: Synthetic oligonucleotide
cuugaauuuuugauguagaugggca

SEQ ID NO: 3453 - DNA, 25 bp, Artificial Sequence
  Description of Artificial Sequence: Synthetic oligonucleotide
  Description of Combined DNA/RNA Molecule: Synthetic oligonucleotide
uagaugggcauuuuuuuaagguagt

SEQ ID NO: 3454 - RNA, 25 nt, Artificial Sequence
  Description of Artificial Sequence: Synthetic oligonucleotide
ggcauuuuuuuaagguagugguuaa

SEQ ID NO: 3455 - DNA, 25 bp, Artificial Sequence
  Description of Artificial Sequence: Synthetic oligonucleotide
  Description of Artificial Sequence: Synthetic oligonucleotide
agguagugguuaauuaccuuuaugt

SEQ ID NO: 3456 - RNA, 25 nt, Artificial Sequence
  Description of Artificial Sequence: Synthetic oligonucleotide
guagugguuaauuaccuuuauguga

SEQ ID NO: 3457 - RNA, 25 nt, Artificial Sequence
  Description of Artificial Sequence: Synthetic oligonucleotide
uagugguuaauuaccuuuaugugaa

SEQ ID NO: 3458 - RNA, 25 nt, Artificial Sequence
  Description of Artificial Sequence: Synthetic oligonucleotide
agugguuaauuaccuuuaugugaac

SEQ ID NO: 3459 - DNA, 25 bp, Artificial Sequence
  Description of Artificial Sequence: Synthetic oligonucleotide
  Description of Combined DNA/RNA Molecule: Synthetic oligonucleotide
gugguuaauuaccuuuaugugaact

SEQ ID NO: 3460 - DNA, 25 bp, Artificial Sequence
  Description of Artificial Sequence: Synthetic oligonucleotide
  Description of Combined DNA/RNA Molecule: Synthetic oligonucleotide
accuuuaugugaacuuugaauggtt

SEQ ID NO: 3461 - RNA, 25 nt, Artificial Sequence
  Description of Artificial Sequence: Synthetic oligonucleotide
uaugugaacuuugaaugguuuaaca

SEQ ID NO: 3462 - DNA, 25 bp, Artificial Sequence
  Description of Artificial Sequence: Synthetic oligonucleotide
  Description of Combined DNA/RNA Molecule: Synthetic oligonucleotide
aacuuugaaugguuuaacaaaagat

SEQ ID NO: 3463 - DNA, 25 bp, Artificial Sequence
  Description of Artificial Sequence: Synthetic oligonucleotide
  Description of Combined DNA/RNA Molecule: Synthetic oligonucleotide
uugaaugguuuaacaaaagauuugt

SEQ ID NO: 3464 - DNA, 25 bp, Artificial Sequence
  Description of Artificial Sequence: Synthetic oligonucleotide
  Description of Combined DNA/RNA Molecule: Synthetic oligonucleotide
ugaaugguuuaacaaaagauuugtt

SEQ ID NO: 3465 - DNA, 25 bp, Artificial Sequence
  Description of Artificial Sequence: Synthetic oligonucleotide
  Description of Combined DNA/RNA Molecule: Synthetic oligonucleotide
gaaugguuuaacaaaagauuugutt

SEQ ID NO: 3466 - DNA, 25 bp, Artificial Sequence
  Description of Artificial Sequence: Synthetic oligonucleotide
  Description of Combined DNA/RNA Molecule: Synthetic oligonucleotide
aaugguuuaacaaaagauuuguutt

SEQ ID NO: 3467 - DNA, 25 bp, Artificial Sequence
  Description of Artificial Sequence: Synthetic oligonucleotide
  Description of Combined DNA/RNA Molecule: Synthetic oligonucleotide
augguuuaacaaaagauuuguuutt

SEQ ID NO: 3468 - DNA, 25 bp, Artificial Sequence
  Description of Artificial Sequence: Synthetic oligonucleotide
  Description of Combined DNA/RNA Molecule: Synthetic oligonucleotide
gguuuaacaaaagauuuguuuuugt

SEQ ID NO: 3469 - DNA, 25 bp, Artificial Sequence
  Description of Artificial Sequence: Synthetic oligonucleotide
  Description of Combined DNA/RNA Molecule: Synthetic oligonucleotide
guuuaacaaaagauuuguuuuugta

SEQ ID NO: 3470 - RNA, 25 nt, Artificial Sequence
  Description of Artificial Sequence: Synthetic oligonucleotide
aacaaaagauuuguuuuuguagaga

SEQ ID NO: 3471 - DNA, 25 bp, Artificial Sequence
  Description of Artificial Sequence: Synthetic oligonucleotide
  Description of Combined DNA/RNA Molecule: Synthetic oligonucleotide
acaaaagauuuguuuuuguagagat

SEQ ID NO: 3472 - DNA, 25 bp, Artificial Sequence
  Description of Artificial Sequence: Synthetic oligonucleotide
  Description of Combined DNA/RNA Molecule: Synthetic oligonucleotide
caaaagauuuguuuuuguagagatt

SEQ ID NO: 3473 - DNA, 25 bp, Artificial Sequence
  Description of Artificial Sequence: Synthetic oligonucleotide
  Description of Combined DNA/RNA Molecule: Synthetic oligonucleotide
aaagauuuguuuuuguagagauutt

SEQ ID NO: 3474 - DNA, 25 bp, Artificial Sequence
  Description of Artificial Sequence: Synthetic oligonucleotide
  Description of Combined DNA/RNA Molecule: Synthetic oligonucleotide
aagauuuguuuuuguagagauuuta

SEQ ID NO: 3475 - RNA, 25 nt, Artificial Sequence
  Description of Artificial Sequence: Synthetic oligonucleotide
agauuuguuuuuguagagauuuuaa

SEQ ID NO: 3476 - RNA, 25 nt, Artificial Sequence
  Description of Artificial Sequence: Synthetic oligonucleotide
gauuuguuuuuguagagauuuuaaa

SEQ ID NO: 3477 - RNA, 25 nt, Artificial Sequence
  Description of Artificial Sequence: Synthetic oligonucleotide
uuuuuguagagauuuuaaaggggga

SEQ ID NO: 3478 - DNA, 25 bp, Artificial Sequence
  Description of Artificial Sequence: Synthetic oligonucleotide
  Description of Combined DNA/RNA Molecule: Synthetic oligonucleotide
aagggggagaauucuagaaauaaat

SEQ ID NO: 3479 - DNA, 25 bp, Artificial Sequence
  Description of Artificial Sequence: Synthetic oligonucleotide
  Description of Combined DNA/RNA Molecule: Synthetic oligonucleotide
gggggagaauucuagaaauaaaugt

SEQ ID NO: 3480 - DNA, 25 bp, Artificial Sequence
  Description of Artificial Sequence: Synthetic oligonucleotide
  Description of Combined DNA/RNA Molecule: Synthetic oligonucleotide
ggggagaauucuagaaauaaaugtt

SEQ ID NO: 3481 - DNA, 25 bp, Artificial Sequence
  Description of Artificial Sequence: Synthetic oligonucleotide
  Description of Combined DNA/RNA Molecule: Synthetic oligonucleotide
gggagaauucuagaaauaaauguta

SEQ ID NO: 3482 - RNA, 25 nt, Artificial Sequence
  Description of Artificial Sequence: Synthetic oligonucleotide
ggagaauucuagaaauaaauguuac

SEQ ID NO: 3483 - RNA, 25 nt, Artificial Sequence
  Description of Artificial Sequence: Synthetic oligonucleotide
gagaauucuagaaauaaauguuacc

SEQ ID NO: 3484 - DNA, 25 bp, Artificial Sequence
  Description of Artificial Sequence: Synthetic oligonucleotide
  Description of Combined DNA/RNA Molecule: Synthetic oligonucleotide
uucuagaaauaaauguuaccuaatt

SEQ ID NO: 3485 - DNA, 25 bp, Artificial Sequence
  Description of Artificial Sequence: Synthetic oligonucleotide
  Description of Combined DNA/RNA Molecule: Synthetic oligonucleotide
ucuagaaauaaauguuaccuaauta

SEQ ID NO: 3486 - DNA, 25 bp, Artificial Sequence
  Description of Artificial Sequence: Synthetic oligonucleotide
  Description of Combined DNA/RNA Molecule: Synthetic oligonucleotide
cuagaaauaaauguuaccuaauuat

SEQ ID NO: 3487 - DNA, 25 bp, Artificial Sequence
  Description of Artificial Sequence: Synthetic oligonucleotide
  Description of Combined DNA/RNA Molecule: Synthetic oligonucleotide
uagaaauaaauguuaccuaauuatt

SEQ ID NO: 3488 - DNA, 25 bp, Artificial Sequence
  Description of Artificial Sequence: Synthetic oligonucleotide
  Description of Combined DNA/RNA Molecule: Synthetic oligonucleotide
agaaauaaauguuaccuaauuauta

SEQ ID NO: 3489 - RNA, 25 nt, Artificial Sequence
  Description of Artificial Sequence: Synthetic oligonucleotide
aaauaaauguuaccuaauuauuaca

SEQ ID NO: 3490 - RNA, 25 nt, Artificial Sequence
  Description of Artificial Sequence: Synthetic oligonucleotide
accuaauuauuacagccuuaaagac

SEQ ID NO: 3491 - RNA, 25 nt, Artificial Sequence
  Description of Artificial Sequence: Synthetic oligonucleotide
ccuaauuauuacagccuuaaagaca

SEQ ID NO: 3492 - RNA, 25 nt, Artificial Sequence
  Description of Artificial Sequence: Synthetic oligonucleotide
ccuuaaagacaaaaauccuuguuga

SEQ ID NO: 3493 - DNA, 25 bp, Artificial Sequence
  Description of Artificial Sequence: Synthetic oligonucleotide
  Description of Combined DNA/RNA Molecule: Synthetic oligonucleotide
uaaagacaaaaauccuuguugaagt

SEQ ID NO: 3494 - RNA, 25 nt, Artificial Sequence
  Description of Artificial Sequence: Synthetic oligonucleotide
uccuuguugaaguuuuuuuaaaaaa

SEQ ID NO: 3495 - RNA, 25 nt, Artificial Sequence
  Description of Artificial Sequence: Synthetic oligonucleotide
ccuuguugaaguuuuuuuaaaaaaa

SEQ ID NO: 3496 - RNA, 25 nt, Artificial Sequence
  Description of Artificial Sequence: Synthetic oligonucleotide
uuguugaaguuuuuuuaaaaaaagc

SEQ ID NO: 3497 - DNA, 25 bp, Artificial Sequence
  Description of Artificial Sequence: Synthetic oligonucleotide
  Description of Combined DNA/RNA Molecule: Synthetic oligonucleotide
uguugaaguuuuuuuaaaaaaagct

SEQ ID NO: 3498 - DNA, 25 bp, Artificial Sequence
  Description of Artificial Sequence: Synthetic oligonucleotide
  Description of Combined DNA/RNA Molecule: Synthetic oligonucleotide
gaaguuuuuuuaaaaaaagcuaaat

SEQ ID NO: 3499 - DNA, 25 bp, Artificial Sequence
  Description of Artificial Sequence: Synthetic oligonucleotide
  Description of Combined DNA/RNA Molecule: Synthetic oligonucleotide
aaguuuuuuuaaaaaaagcuaaatt

SEQ ID NO: 3500 - DNA, 25 bp, Artificial Sequence
  Description of Artificial Sequence: Synthetic oligonucleotide
  Description of Combined DNA/RNA Molecule: Synthetic oligonucleotide
aguuuuuuuaaaaaaagcuaaauta

SEQ ID NO: 3501 - RNA, 25 nt, Artificial Sequence
  Description of Artificial Sequence: Synthetic oligonucleotide
guuuuuuuaaaaaaagcuaaauuac

SEQ ID NO: 3502 - RNA, 25 nt, Artificial Sequence
  Description of Artificial Sequence: Synthetic oligonucleotide
uuuuuuuaaaaaaagcuaaauuaca

SEQ ID NO: 3503 - RNA, 25 nt, Artificial Sequence
  Description of Artificial Sequence: Synthetic oligonucleotide
uuuaaaaaaagcuaaauuacauaga

SEQ ID NO: 3504 - DNA, 25 bp, Artificial Sequence
  Description of Artificial Sequence: Synthetic oligonucleotide
  Description of Combined DNA/RNA Molecule: Synthetic oligonucleotide
uaaaaaaagcuaaauuacauagact

SEQ ID NO: 3505 - RNA, 25 nt, Artificial Sequence
  Description of Artificial Sequence: Synthetic oligonucleotide
acuuaggcauuaacauguuugugga

SEQ ID NO: 3506 - RNA, 25 nt, Artificial Sequence
  Description of Artificial Sequence: Synthetic oligonucleotide
cuuaggcauuaacauguuuguggaa

SEQ ID NO: 3507 - RNA, 25 nt, Artificial Sequence
  Description of Artificial Sequence: Synthetic oligonucleotide
agcagacguauauuguaucauuuga

SEQ ID NO: 3508 - RNA, 25 nt, Artificial Sequence
  Description of Artificial Sequence: Synthetic oligonucleotide
gacguauauuguaucauuugaguga

SEQ ID NO: 3509 - DNA, 25 bp, Artificial Sequence
  Description of Artificial Sequence: Synthetic oligonucleotide
  Description of Combined DNA/RNA Molecule: Synthetic oligonucleotide
cguauauuguaucauuugagugaat

SEQ ID NO: 3510 - DNA, 25 bp, Artificial Sequence
  Description of Artificial Sequence: Synthetic oligonucleotide
  Description of Combined DNA/RNA Molecule: Synthetic oligonucleotide
auauuguaucauuugagugaaugtt

SEQ ID NO: 3511 - DNA, 25 bp, Artificial Sequence
  Description of Artificial Sequence: Synthetic oligonucleotide
  Description of Combined DNA/RNA Molecule: Synthetic oligonucleotide
uauuguaucauuugagugaaugutc

SEQ ID NO: 3512 - RNA, 25 nt, Artificial Sequence
  Description of Artificial Sequence: Synthetic oligonucleotide
auuguaucauuugagugaauguucc

SEQ ID NO: 3513 - DNA, 25 bp, Artificial Sequence
  Description of Artificial Sequence: Synthetic oligonucleotide
  Description of Combined DNA/RNA Molecule: Synthetic oligonucleotide
auaggaauuuagaaccuaacuuuta

SEQ ID NO: 3514 - DNA, 25 bp, Artificial Sequence
  Description of Artificial Sequence: Synthetic oligonucleotide
  Description of Combined DNA/RNA Molecule: Synthetic oligonucleotide
uaggaauuuagaaccuaacuuuuat

SEQ ID NO: 3515 - DNA, 25 bp, Artificial Sequence
  Description of Artificial Sequence: Synthetic oligonucleotide
  Description of Combined DNA/RNA Molecule: Synthetic oligonucleotide
aauuuagaaccuaacuuuuauaggt

SEQ ID NO: 3516 - DNA, 25 bp, Artificial Sequence
  Description of Artificial Sequence: Synthetic oligonucleotide
  Description of Combined DNA/RNA Molecule: Synthetic oligonucleotide
auuuagaaccuaacuuuuauaggtt

SEQ ID NO: 3517 - DNA, 25 bp, Artificial Sequence
  Description of Artificial Sequence: Synthetic oligonucleotide
  Description of Combined DNA/RNA Molecule: Synthetic oligonucleotide
uuuagaaccuaacuuuuauagguta

SEQ ID NO: 3518 - DNA, 25 bp, Artificial Sequence
  Description of Artificial Sequence: Synthetic oligonucleotide
  Description of Combined DNA/RNA Molecule: Synthetic oligonucleotide
uuagaaccuaacuuuuauagguuat

SEQ ID NO: 3519 - DNA, 25 bp, Artificial Sequence
  Description of Artificial Sequence: Synthetic oligonucleotide
  Description of Combined DNA/RNA Molecule: Synthetic oligonucleotide
uuuuauagguuaucaaaacuguugt

SEQ ID NO: 3520 - RNA, 25 nt, Artificial Sequence
  Description of Artificial Sequence: Synthetic oligonucleotide
uuauagguuaucaaaacuguuguca

SEQ ID NO: 3521 - RNA, 25 nt, Artificial Sequence
  Description of Artificial Sequence: Synthetic oligonucleotide
aauuuuguccuaauauauacauaga

SEQ ID NO: 3522 - RNA, 25 nt, Artificial Sequence
  Description of Artificial Sequence: Synthetic oligonucleotide
auuuuguccuaauauauacauagaa

SEQ ID NO: 3523 - RNA, 25 nt, Artificial Sequence
  Description of Artificial Sequence: Synthetic oligonucleotide
uuuuguccuaauauauacauagaaa

SEQ ID NO: 3524 - DNA, 25 bp, Artificial Sequence
  Description of Artificial Sequence: Synthetic oligonucleotide
  Description of Combined DNA/RNA Molecule: Synthetic oligonucleotide
ccuaauauauacauagaaacuuugt

SEQ ID NO: 3525 - RNA, 25 nt, Artificial Sequence
  Description of Artificial Sequence: Synthetic oligonucleotide
uauauacauagaaacuuuguggggc

SEQ ID NO: 3526 - RNA, 25 nt, Artificial Sequence
  Description of Artificial Sequence: Synthetic oligonucleotide
cacaaguucaucucauuuguauucc

SEQ ID NO: 3527 - DNA, 25 bp, Artificial Sequence
  Description of Artificial Sequence: Synthetic oligonucleotide
  Description of Combined DNA/RNA Molecule: Synthetic oligonucleotide
cucauuuguauuccauugauuuutt

SEQ ID NO: 3528 - DNA, 25 bp, Artificial Sequence
  Description of Artificial Sequence: Synthetic oligonucleotide
  Description of Combined DNA/RNA Molecule: Synthetic oligonucleotide
ucauuuguauuccauugauuuuutt

SEQ ID NO: 3529 - DNA, 25 bp, Artificial Sequence
  Description of Artificial Sequence: Synthetic oligonucleotide
  Description of Combined DNA/RNA Molecule: Synthetic oligonucleotide
cauuuguauuccauugauuuuuutt

SEQ ID NO: 3530 - DNA, 25 bp, Artificial Sequence
  Description of Artificial Sequence: Synthetic oligonucleotide
  Description of Combined DNA/RNA Molecule: Synthetic oligonucleotide
auuuguauuccauugauuuuuuutt

SEQ ID NO: 3531 - DNA, 25 bp, Artificial Sequence
  Description of Artificial Sequence: Synthetic oligonucleotide
  Description of Combined DNA/RNA Molecule: Synthetic oligonucleotide
uuuguauuccauugauuuuuuuutt

SEQ ID NO: 3532 - DNA, 25 bp, Artificial Sequence
  Description of Artificial Sequence: Synthetic oligonucleotide
  Description of Combined DNA/RNA Molecule: Synthetic oligonucleotide
uuguauuccauugauuuuuuuuutc

SEQ ID NO: 3533 - DNA, 25 bp, Artificial Sequence
  Description of Artificial Sequence: Synthetic oligonucleotide
  Description of Combined DNA/RNA Molecule: Synthetic oligonucleotide
uguauuccauugauuuuuuuuuuct

SEQ ID NO: 3534 - RNA, 25 nt, Artificial Sequence
  Description of Artificial Sequence: Synthetic oligonucleotide
cauugauuuuuuuuuucuucuaaac

SEQ ID NO: 3535 - RNA, 25 nt, Artificial Sequence
  Description of Artificial Sequence: Synthetic oligonucleotide
auugauuuuuuuuuucuucuaaaca

SEQ ID NO: 3536 - DNA, 25 bp, Artificial Sequence
  Description of Artificial Sequence: Synthetic oligonucleotide
  Description of Combined DNA/RNA Molecule: Synthetic oligonucleotide
auuuuuuuuuucuucuaaacauutt

SEQ ID NO: 3537 - DNA, 25 bp, Artificial Sequence
  Description of Artificial Sequence: Synthetic oligonucleotide
  Description of Combined DNA/RNA Molecule: Synthetic oligonucleotide
uuuuuuuuuucuucuaaacauuutt

SEQ ID NO: 3538 - DNA, 25 bp, Artificial Sequence
  Description of Artificial Sequence: Synthetic oligonucleotide
  Description of Combined DNA/RNA Molecule: Synthetic oligonucleotide
uuuuuuuuucuucuaaacauuuutt

SEQ ID NO: 3539 - DNA, 25 bp, Artificial Sequence
  Description of Artificial Sequence: Synthetic oligonucleotide
  Description of Combined DNA/RNA Molecule: Synthetic oligonucleotide
uuuuuuuucuucuaaacauuuuutc

SEQ ID NO: 3540 - DNA, 25 bp, Artificial Sequence
  Description of Artificial Sequence: Synthetic oligonucleotide
  Description of Combined DNA/RNA Molecule: Synthetic oligonucleotide
uuuuuuucuucuaaacauuuuuuct

SEQ ID NO: 3541 - DNA, 25 bp, Artificial Sequence
  Description of Artificial Sequence: Synthetic oligonucleotide
  Description of Combined DNA/RNA Molecule: Synthetic oligonucleotide
aacauuuuuucuucaaacaguauat

SEQ ID NO: 3542 - DNA, 25 bp, Artificial Sequence
  Description of Artificial Sequence: Synthetic oligonucleotide
  Description of Combined DNA/RNA Molecule: Synthetic oligonucleotide
acauuuuuucuucaaacaguauata

SEQ ID NO: 3543 - RNA, 25 nt, Artificial Sequence
  Description of Artificial Sequence: Synthetic oligonucleotide
cauuuuuucuucaaacaguauauaa

SEQ ID NO: 3544 - RNA, 25 nt, Artificial Sequence
  Description of Artificial Sequence: Synthetic oligonucleotide
auuuuuucuucaaacaguauauaac

SEQ ID NO: 3545 - DNA, 25 bp, Artificial Sequence
  Description of Artificial Sequence: Synthetic oligonucleotide
  Description of Combined DNA/RNA Molecule: Synthetic oligonucleotide
uuuuuucuucaaacaguauauaact

SEQ ID NO: 3546 - DNA, 25 bp, Artificial Sequence
  Description of Artificial Sequence: Synthetic oligonucleotide
  Description of Combined DNA/RNA Molecule: Synthetic oligonucleotide
uucaaacaguauauaacuuuuuuta

SEQ ID NO: 3547 - RNA, 25 nt, Artificial Sequence
  Description of Artificial Sequence: Synthetic oligonucleotide
acaguauauaacuuuuuuuagggga

SEQ ID NO: 3548 - DNA, 25 bp, Artificial Sequence
  Description of Artificial Sequence: Synthetic oligonucleotide
  Description of Combined DNA/RNA Molecule: Synthetic oligonucleotide
caguauauaacuuuuuuuaggggat

SEQ ID NO: 3549 - DNA, 25 bp, Artificial Sequence
  Description of Artificial Sequence: Synthetic oligonucleotide
  Description of Combined DNA/RNA Molecule: Synthetic oligonucleotide
aguauauaacuuuuuuuaggggatt

SEQ ID NO: 3550 - DNA, 25 bp, Artificial Sequence
  Description of Artificial Sequence: Synthetic oligonucleotide
  Description of Combined DNA/RNA Molecule: Synthetic oligonucleotide
guauauaacuuuuuuuaggggautt

SEQ ID NO: 3551 - DNA, 25 bp, Artificial Sequence
  Description of Artificial Sequence: Synthetic oligonucleotide
  Description of Combined DNA/RNA Molecule: Synthetic oligonucleotide
aacuuuuuuuaggggauuuuuuutt

SEQ ID NO: 3552 - DNA, 25 bp, Artificial Sequence
  Description of Artificial Sequence: Synthetic oligonucleotide
  Description of Combined DNA/RNA Molecule: Synthetic oligonucleotide
acuuuuuuuaggggauuuuuuuuta

SEQ ID NO: 3553 - RNA, 25 nt, Artificial Sequence
  Description of Artificial Sequence: Synthetic oligonucleotide
gggauuuuuuuuuagacagcaaaaa

SEQ ID NO: 3554 - RNA, 25 nt, Artificial Sequence
  Description of Artificial Sequence: Synthetic oligonucleotide
ggauuuuuuuuuagacagcaaaaac

SEQ ID NO: 3555 - DNA, 25 bp, Artificial Sequence
  Description of Artificial Sequence: Synthetic oligonucleotide
  Description of Combined DNA/RNA Molecule: Synthetic oligonucleotide
gauuuuuuuuuagacagcaaaaact

SEQ ID NO: 3556 - DNA, 25 bp, Artificial Sequence
  Description of Artificial Sequence: Synthetic oligonucleotide
  Description of Combined DNA/RNA Molecule: Synthetic oligonucleotide
ugaagauuuccauuugucaaaaagt

SEQ ID NO: 3557 - DNA, 25 bp, Artificial Sequence
  Description of Artificial Sequence: Synthetic oligonucleotide
  Description of Combined DNA/RNA Molecule: Synthetic oligonucleotide
gaagauuuccauuugucaaaaagta

SEQ ID NO: 3558 - RNA, 25 nt, Artificial Sequence
  Description of Artificial Sequence: Synthetic oligonucleotide
aagauuuccauuugucaaaaaguaa

SEQ ID NO: 3559 - DNA, 25 bp, Artificial Sequence
  Description of Artificial Sequence: Synthetic oligonucleotide
  Description of Combined DNA/RNA Molecule: Synthetic oligonucleotide
agauuuccauuugucaaaaaguaat

SEQ ID NO: 3560 - DNA, 25 bp, Artificial Sequence
  Description of Artificial Sequence: Synthetic oligonucleotide
  Description of Combined DNA/RNA Molecule: Synthetic oligonucleotide
uccauuugucaaaaaguaaugautt

SEQ ID NO: 3561 - DNA, 25 bp, Artificial Sequence
  Description of Artificial Sequence: Synthetic oligonucleotide
  Description of Combined DNA/RNA Molecule: Synthetic oligonucleotide
ccauuugucaaaaaguaaugauutc

SEQ ID NO: 3562 - DNA, 25 bp, Artificial Sequence
  Description of Artificial Sequence: Synthetic oligonucleotide
  Description of Combined DNA/RNA Molecule: Synthetic oligonucleotide
cauuugucaaaaaguaaugauuuct

SEQ ID NO: 3563 - DNA, 25 bp, Artificial Sequence
  Description of Artificial Sequence: Synthetic oligonucleotide
  Description of Combined DNA/RNA Molecule: Synthetic oligonucleotide
gucaaaaaguaaugauuucuugata

SEQ ID NO: 3564 - RNA, 25 nt, Artificial Sequence
  Description of Artificial Sequence: Synthetic oligonucleotide
ucaaaaaguaaugauuucuugauaa

SEQ ID NO: 3565 - DNA, 25 bp, Artificial Sequence
  Description of Artificial Sequence: Synthetic oligonucleotide
  Description of Combined DNA/RNA Molecule: Synthetic oligonucleotide
caaaaaguaaugauuucuugauaat

SEQ ID NO: 3566 - DNA, 25 bp, Artificial Sequence
  Description of Artificial Sequence: Synthetic oligonucleotide
  Description of Combined DNA/RNA Molecule: Synthetic oligonucleotide
aaaaaguaaugauuucuugauaatt

SEQ ID NO: 3567 - DNA, 25 bp, Artificial Sequence
  Description of Artificial Sequence: Synthetic oligonucleotide
  Description of Combined DNA/RNA Molecule: Synthetic oligonucleotide
aaaguaaugauuucuugauaauugt

SEQ ID NO: 3568 - DNA, 25 bp, Artificial Sequence
  Description of Artificial Sequence: Synthetic oligonucleotide
  Description of Combined DNA/RNA Molecule: Synthetic oligonucleotide
aguaaugauuucuugauaauugugt

SEQ ID NO: 3569 - DNA, 25 bp, Artificial Sequence
  Description of Artificial Sequence: Synthetic oligonucleotide
  Description of Artificial Sequence: Synthetic oligonucleotide
guaaugauuucuugauaauugugta

SEQ ID NO: 3570 - DNA, 25 bp, Artificial Sequence
  Description of Artificial Sequence: Synthetic oligonucleotide
  Description of Combined DNA/RNA Molecule: Synthetic oligonucleotide
aaugauuucuugauaauuguguagt

SEQ ID NO: 3571 - DNA, 25 bp, Artificial Sequence
  Description of Artificial Sequence: Synthetic oligonucleotide
  Description of Combined DNA/RNA Molecule: Synthetic oligonucleotide
augauuucuugauaauuguguagta

SEQ ID NO: 3572 - DNA, 25 bp, Artificial Sequence
  Description of Artificial Sequence: Synthetic oligonucleotide
  Description of Combined DNA/RNA Molecule: Synthetic oligonucleotide
uucuugauaauuguguaguaaugtt

SEQ ID NO: 3573 - DNA, 25 bp, Artificial Sequence
  Description of Artificial Sequence: Synthetic oligonucleotide
  Description of Combined DNA/RNA Molecule: Synthetic oligonucleotide
ucuugauaauuguguaguaaugutt

SEQ ID NO: 3574 - DNA, 25 bp, Artificial Sequence
  Description of Artificial Sequence: Synthetic oligonucleotide
  Description of Combined DNA/RNA Molecule: Synthetic oligonucleotide
cuugauaauuguguaguaauguutt

SEQ ID NO: 3575 - DNA, 25 bp, Artificial Sequence
  Description of Artificial Sequence: Synthetic oligonucleotide
  Description of Combined DNA/RNA Molecule: Synthetic oligonucleotide
ugauaauuguguaguaauguuuutt

SEQ ID NO: 3576 - RNA, 25 nt, Artificial Sequence
  Description of Artificial Sequence: Synthetic oligonucleotide
uaauuguguaguaauguuuuuuaga

SEQ ID NO: 3577 - RNA, 25 nt, Artificial Sequence
  Description of Artificial Sequence: Synthetic oligonucleotide
auuguguaguaauguuuuuuagaac

SEQ ID NO: 3578 - RNA, 25 nt, Artificial Sequence
  Description of Artificial Sequence: Synthetic oligonucleotide
uuguguaguaauguuuuuuagaacc

SEQ ID NO: 3579 - DNA, 25 bp, Artificial Sequence
  Description of Artificial Sequence: Synthetic oligonucleotide
  Description of Combined DNA/RNA Molecule: Synthetic oligonucleotide
ccuuaaagcugaauuuauauuuagt

SEQ ID NO: 3580 - RNA, 25 nt, Artificial Sequence
  Description of Artificial Sequence: Synthetic oligonucleotide
uuaaagcugaauuuauauuuaguaa

SEQ ID NO: 3581 - DNA, 25 bp, Artificial Sequence
  Description of Artificial Sequence: Synthetic oligonucleotide
  Description of Combined DNA/RNA Molecule: Synthetic oligonucleotide
aauuuauauuuaguaacuucugugt

SEQ ID NO: 3582 - DNA, 25 bp, Artificial Sequence
  Description of Artificial Sequence: Synthetic oligonucleotide
  Description of Combined DNA/RNA Molecule: Synthetic oligonucleotide
auuuauauuuaguaacuucugugtt

SEQ ID NO: 3583 - DNA, 25 bp, Artificial Sequence
  Description of Artificial Sequence: Synthetic oligonucleotide
  Description of Combined DNA/RNA Molecule: Synthetic oligonucleotide
uuuauauuuaguaacuucuguguta

SEQ ID NO: 3584 - DNA, 25 bp, Artificial Sequence
  Description of Artificial Sequence: Synthetic oligonucleotide
  Description of Combined DNA/RNA Molecule: Synthetic oligonucleotide
auuuaguaacuucuguguuaauact

SEQ ID NO: 3585 - RNA, 25 nt, Artificial Sequence
  Description of Artificial Sequence: Synthetic oligonucleotide
acugaauagcugucauaaaaugaaa

SEQ ID NO: 3586 - RNA, 25 nt, Artificial Sequence
  Description of Artificial Sequence: Synthetic oligonucleotide
cugaauagcugucauaaaaugaaac

SEQ ID NO: 3587 - RNA, 25 nt, Artificial Sequence
  Description of Artificial Sequence: Synthetic oligonucleotide
uaaaaugaaacuuucuuucuaaaga

SEQ ID NO: 3588 - RNA, 25 nt, Artificial Sequence
  Description of Artificial Sequence: Synthetic oligonucleotide
aaaaugaaacuuucuuucuaaagaa

SEQ ID NO: 3589 - RNA, 25 nt, Artificial Sequence
  Description of Artificial Sequence: Synthetic oligonucleotide
aaaugaaacuuucuuucuaaagaaa

SEQ ID NO: 3590 - RNA, 25 nt, Artificial Sequence
  Description of Artificial Sequence: Synthetic oligonucleotide
augaaacuuucuuucuaaagaaaga

SEQ ID NO: 3591 - DNA, 25 bp, Artificial Sequence
  Description of Artificial Sequence: Synthetic oligonucleotide
  Description of Combined DNA/RNA Molecule: Synthetic oligonucleotide
aacuuucuuucuaaagaaagauact

SEQ ID NO: 3592 - RNA, 25 nt, Artificial Sequence
  Description of Artificial Sequence: Synthetic oligonucleotide
cacaugaguucuugaagaauaguca

SEQ ID NO: 3593 - DNA, 25 bp, Artificial Sequence
  Description of Artificial Sequence: Synthetic oligonucleotide
  Description of Combined DNA/RNA Molecule: Synthetic oligonucleotide
ucuugaagaauagucauaacuagat

SEQ ID NO: 3594 - DNA, 25 bp, Artificial Sequence
  Description of Artificial Sequence: Synthetic oligonucleotide
  Description of Combined DNA/RNA Molecule: Synthetic oligonucleotide
cuugaagaauagucauaacuagatt

SEQ ID NO: 3595 - DNA, 25 bp, Artificial Sequence
  Description of Artificial Sequence: Synthetic oligonucleotide
  Description of Combined DNA/RNA Molecule: Synthetic oligonucleotide
uugaagaauagucauaacuagauta

SEQ ID NO: 3596 - RNA, 25 nt, Artificial Sequence
  Description of Artificial Sequence: Synthetic oligonucleotide
aagaauagucauaacuagauuaaga

SEQ ID NO: 3597 - DNA, 25 bp, Artificial Sequence
  Description of Artificial Sequence: Synthetic oligonucleotide
  Description of Combined DNA/RNA Molecule: Synthetic oligonucleotide
agaauagucauaacuagauuaagat

SEQ ID NO: 3598 - DNA, 25 bp, Artificial Sequence
  Description of Artificial Sequence: Synthetic oligonucleotide
  Description of Combined DNA/RNA Molecule: Synthetic oligonucleotide
gaauagucauaacuagauuaagatc

SEQ ID NO: 3599 - DNA, 25 bp, Artificial Sequence
  Description of Artificial Sequence: Synthetic oligonucleotide
  Description of Combined DNA/RNA Molecule: Synthetic oligonucleotide
aauagucauaacuagauuaagauct

SEQ ID NO: 3600 - DNA, 25 bp, Artificial Sequence
  Description of Artificial Sequence: Synthetic oligonucleotide
  Description of Combined DNA/RNA Molecule: Synthetic oligonucleotide
gucauaacuagauuaagaucugugt

SEQ ID NO: 3601 - DNA, 25 bp, Artificial Sequence
  Description of Artificial Sequence: Synthetic oligonucleotide
  Description of Combined DNA/RNA Molecule: Synthetic oligonucleotide
acuagauuaagaucuguguuuuagt

SEQ ID NO: 3602 - DNA, 25 bp, Artificial Sequence
  Description of Artificial Sequence: Synthetic oligonucleotide
  Description of Combined DNA/RNA Molecule: Synthetic oligonucleotide
uagauuaagaucuguguuuuagutt

SEQ ID NO: 3603 - DNA, 25 bp, Artificial Sequence
  Description of Artificial Sequence: Synthetic oligonucleotide
  Description of Combined DNA/RNA Molecule: Synthetic oligonucleotide
agauuaagaucuguguuuuaguuta

SEQ ID NO: 3604 - DNA, 25 bp, Artificial Sequence
  Description of Artificial Sequence: Synthetic oligonucleotide
  Description of Combined DNA/RNA Molecule: Synthetic oligonucleotide
auuaagaucuguguuuuaguuuaat

SEQ ID NO: 3605 - RNA, 25 nt, Artificial Sequence
  Description of Artificial Sequence: Synthetic oligonucleotide
ucuguguuuuaguuuaauaguuuga

SEQ ID NO: 3606 - RNA, 25 nt, Artificial Sequence
  Description of Artificial Sequence: Synthetic oligonucleotide
cuguguuuuaguuuaauaguuugaa

SEQ ID NO: 3607 - DNA, 25 bp, Artificial Sequence
  Description of Artificial Sequence: Synthetic oligonucleotide
  Description of Combined DNA/RNA Molecule: Synthetic oligonucleotide
guguuuuaguuuaauaguuugaagt

SEQ ID NO: 3608 - RNA, 25 nt, Artificial Sequence
  Description of Artificial Sequence: Synthetic oligonucleotide
guuuuaguuuaauaguuugaagugc

SEQ ID NO: 3609 - RNA, 25 nt, Artificial Sequence
  Description of Artificial Sequence: Synthetic oligonucleotide
uuuuaguuuaauaguuugaagugcc

SEQ ID NO: 3610 - DNA, 25 bp, Artificial Sequence
  Description of Artificial Sequence: Synthetic oligonucleotide
  Description of Combined DNA/RNA Molecule: Synthetic oligonucleotide
guuugggauaaugauagguaauuta

SEQ ID NO: 3611 - RNA, 25 nt, Artificial Sequence
  Description of Artificial Sequence: Synthetic oligonucleotide
uugggauaaugauagguaauuuaga

SEQ ID NO: 3612 - RNA, 25 nt, Artificial Sequence
  Description of Artificial Sequence: Synthetic oligonucleotide
ggauaaugauagguaauuuagauga

SEQ ID NO: 3613 - RNA, 25 nt, Artificial Sequence
  Description of Artificial Sequence: Synthetic oligonucleotide
gauaaugauagguaauuuagaugaa

SEQ ID NO: 3614 - DNA, 25 bp, Artificial Sequence
  Description of Artificial Sequence: Synthetic oligonucleotide
  Description of Combined DNA/RNA Molecule: Synthetic oligonucleotide
aaugauagguaauuuagaugaautt

SEQ ID NO: 3615 - DNA, 25 bp, Artificial Sequence
  Description of Artificial Sequence: Synthetic oligonucleotide
  Description of Combined DNA/RNA Molecule: Synthetic oligonucleotide
augauagguaauuuagaugaauuta

SEQ ID NO: 3616 - RNA, 25 nt, Artificial Sequence
  Description of Artificial Sequence: Synthetic oligonucleotide
agguaauuuagaugaauuuagggga

SEQ ID NO: 3617 - RNA, 25 nt, Artificial Sequence
  Description of Artificial Sequence: Synthetic oligonucleotide
guaauuuagaugaauuuaggggaaa

SEQ ID NO: 3618 - DNA, 25 bp, Artificial Sequence
  Description of Artificial Sequence: Synthetic oligonucleotide
  Description of Combined DNA/RNA Molecule: Synthetic oligonucleotide
agaugaauuuaggggaaaaaaaagt

SEQ ID NO: 3619 - DNA, 25 bp, Artificial Sequence
  Description of Artificial Sequence: Synthetic oligonucleotide
  Description of Combined DNA/RNA Molecule: Synthetic oligonucleotide
gaugaauuuaggggaaaaaaaagtt

SEQ ID NO: 3620 - DNA, 25 bp, Artificial Sequence
  Description of Artificial Sequence: Synthetic oligonucleotide
  Description of Combined DNA/RNA Molecule: Synthetic oligonucleotide
gggaaaaaaaaguuaucugcagata

SEQ ID NO: 3621 - DNA, 25 bp, Artificial Sequence
  Description of Artificial Sequence: Synthetic oligonucleotide
  Description of Combined DNA/RNA Molecule: Synthetic oligonucleotide
ggaaaaaaaaguuaucugcagauat

SEQ ID NO: 3622 - RNA, 25 nt, Artificial Sequence
  Description of Artificial Sequence: Synthetic oligonucleotide
aaaaaguuaucugcagauauguuga

SEQ ID NO: 3623 - DNA, 25 bp, Artificial Sequence
  Description of Artificial Sequence: Synthetic oligonucleotide
  Description of Combined DNA/RNA Molecule: Synthetic oligonucleotide
gucuuguguuuucauguugaaaata

SEQ ID NO: 3624 - RNA, 25 nt, Artificial Sequence
  Description of Artificial Sequence: Synthetic oligonucleotide
ucuuguguuuucauguugaaaauac

SEQ ID NO: 3625 - DNA, 25 bp, Artificial Sequence
  Description of Artificial Sequence: Synthetic oligonucleotide
  Description of Combined DNA/RNA Molecule: Synthetic oligonucleotide
cuuguguuuucauguugaaaauact

SEQ ID NO: 3626 - DNA, 25 bp, Artificial Sequence
  Description of Artificial Sequence: Synthetic oligonucleotide
  Description of Combined DNA/RNA Molecule: Synthetic oligonucleotide
cauguugaaaauacuuuugcauutt

SEQ ID NO: 3627 - DNA, 25 bp, Artificial Sequence
  Description of Artificial Sequence: Synthetic oligonucleotide
  Description of Combined DNA/RNA Molecule: Synthetic oligonucleotide
auguugaaaauacuuuugcauuutt

SEQ ID NO: 3628 - DNA, 25 bp, Artificial Sequence
  Description of Artificial Sequence: Synthetic oligonucleotide
  Description of Combined DNA/RNA Molecule: Synthetic oligonucleotide
uguugaaaauacuuuugcauuuutc

SEQ ID NO: 3629 - RNA, 25 nt, Artificial Sequence
  Description of Artificial Sequence: Synthetic oligonucleotide
guugaaaauacuuuugcauuuuucc

SEQ ID NO: 3630 - RNA, 25 nt, Artificial Sequence
  Description of Artificial Sequence: Synthetic oligonucleotide
cuuuugcauuuuuccuuugagugcc

SEQ ID NO: 3631 - DNA, 25 bp, Artificial Sequence
  Description of Artificial Sequence: Synthetic oligonucleotide
  Description of Combined DNA/RNA Molecule: Synthetic oligonucleotide
ugagugccaauuucuuacuaguact

SEQ ID NO: 3632 - DNA, 25 bp, Artificial Sequence
  Description of Artificial Sequence: Synthetic oligonucleotide
  Description of Combined DNA/RNA Molecule: Synthetic oligonucleotide
gccaauuucuuacuaguacuauutc

SEQ ID NO: 3633 - DNA, 25 bp, Artificial Sequence
  Description of Artificial Sequence: Synthetic oligonucleotide
  Description of Combined DNA/RNA Molecule: Synthetic oligonucleotide
ccaauuucuuacuaguacuauuuct

SEQ ID NO: 3634 - RNA, 25 nt, Artificial Sequence
  Description of Artificial Sequence: Synthetic oligonucleotide
uacuaguacuauuucuuaauguaac

SEQ ID NO: 3635 - RNA, 25 nt, Artificial Sequence
  Description of Artificial Sequence: Synthetic oligonucleotide
acuaguacuauuucuuaauguaaca

SEQ ID NO: 3636 - DNA, 25 bp, Artificial Sequence
  Description of Artificial Sequence: Synthetic oligonucleotide
  Description of Combined DNA/RNA Molecule: Synthetic oligonucleotide
uacuauuucuuaauguaacaugutt

SEQ ID NO: 3637 - DNA, 25 bp, Artificial Sequence
  Description of Artificial Sequence: Synthetic oligonucleotide
  Description of Combined DNA/RNA Molecule: Synthetic oligonucleotide
acuauuucuuaauguaacauguuta

SEQ ID NO: 3638 - RNA, 25 nt, Artificial Sequence
  Description of Artificial Sequence: Synthetic oligonucleotide
cuauuucuuaauguaacauguuuac

SEQ ID NO: 3639 - DNA, 25 bp, Artificial Sequence
  Description of Artificial Sequence: Synthetic oligonucleotide
  Description of Combined DNA/RNA Molecule: Synthetic oligonucleotide
uuaauguaacauguuuaccuggaat

SEQ ID NO: 3640 - DNA, 25 bp, Artificial Sequence
  Description of Artificial Sequence: Synthetic oligonucleotide
  Description of Combined DNA/RNA Molecule: Synthetic oligonucleotide
ccuggaauguauuuuaacuauuutt

SEQ ID NO: 3641 - DNA, 25 bp, Artificial Sequence
  Description of Artificial Sequence: Synthetic oligonucleotide
  Description of Combined DNA/RNA Molecule: Synthetic oligonucleotide
uggaauguauuuuaacuauuuuugt

SEQ ID NO: 3642 - DNA, 25 bp, Artificial Sequence
  Description of Artificial Sequence: Synthetic oligonucleotide
  Description of Combined DNA/RNA Molecule: Synthetic oligonucleotide
ggaauguauuuuaacuauuuuugta

SEQ ID NO: 3643 - DNA, 25 bp, Artificial Sequence
  Description of Artificial Sequence: Synthetic oligonucleotide
  Description of Combined DNA/RNA Molecule: Synthetic oligonucleotide
gaauguauuuuaacuauuuuuguat

SEQ ID NO: 3644 - DNA, 25 bp, Artificial Sequence
  Description of Artificial Sequence: Synthetic oligonucleotide
  Description of Combined DNA/RNA Molecule: Synthetic oligonucleotide
aauguauuuuaacuauuuuuguata

SEQ ID NO: 3645 - DNA, 25 bp, Artificial Sequence
  Description of Artificial Sequence: Synthetic oligonucleotide
  Description of Combined DNA/RNA Molecule: Synthetic oligonucleotide
uguauuuuaacuauuuuuguauagt

SEQ ID NO: 3646 - DNA, 25 bp, Artificial Sequence
  Description of Artificial Sequence: Synthetic oligonucleotide
  Description of Combined DNA/RNA Molecule: Synthetic oligonucleotide
uauuuuaacuauuuuuguauagugt

SEQ ID NO: 3647 - DNA, 25 bp, Artificial Sequence
  Description of Artificial Sequence: Synthetic oligonucleotide
  Description of Combined DNA/RNA Molecule: Synthetic oligonucleotide
auuuuaacuauuuuuguauagugta

SEQ ID NO: 3648 - RNA, 25 nt, Artificial Sequence
  Description of Artificial Sequence: Synthetic oligonucleotide
uuuuaacuauuuuuguauaguguaa

SEQ ID NO: 3649 - RNA, 25 nt, Artificial Sequence
  Description of Artificial Sequence: Synthetic oligonucleotide
uauuuuuguauaguguaaacugaaa

SEQ ID NO: 3650 - RNA, 25 nt, Artificial Sequence
  Description of Artificial Sequence: Synthetic oligonucleotide
auuuuuguauaguguaaacugaaac

SEQ ID NO: 3651 - RNA, 25 nt, Artificial Sequence
  Description of Artificial Sequence: Synthetic oligonucleotide
uuuuuguauaguguaaacugaaaca

SEQ ID NO: 3652 - RNA, 25 nt, Artificial Sequence
  Description of Artificial Sequence: Synthetic oligonucleotide
aacugaaacaugcacauuuuguaca

SEQ ID NO: 3653 - RNA, 25 nt, Artificial Sequence
  Description of Artificial Sequence: Synthetic oligonucleotide
aacaugcacauuuuguacauugugc

SEQ ID NO: 3654 - DNA, 25 bp, Artificial Sequence
  Description of Artificial Sequence: Synthetic oligonucleotide
  Description of Combined DNA/RNA Molecule: Synthetic oligonucleotide
uccaguuguuuuccaucauuuggtt

SEQ ID NO: 3655 - RNA, 25 nt, Artificial Sequence
  Description of Artificial Sequence: Synthetic oligonucleotide
caguuguuuuccaucauuugguugc

SEQ ID NO: 3656 - RNA, 25 nt, Artificial Sequence
  Description of Artificial Sequence: Synthetic oligonucleotide
auguuggucauaucaaacauuaaaa

SEQ ID NO: 3657 - RNA, 25 nt, Artificial Sequence
  Description of Artificial Sequence: Synthetic oligonucleotide
uguuggucauaucaaacauuaaaaa

SEQ ID NO: 3658 - DNA, 25 bp, Artificial Sequence
  Description of Artificial Sequence: Synthetic oligonucleotide
  Description of Combined DNA/RNA Molecule: Synthetic oligonucleotide
guuggucauaucaaacauuaaaaat

SEQ ID NO: 3659 - RNA, 25 nt, Artificial Sequence
  Description of Artificial Sequence: Synthetic oligonucleotide
gucauaucaaacauuaaaaaugacc

SEQ ID NO: 3660 - RNA, 25 nt, Artificial Sequence
  Description of Artificial Sequence: Synthetic oligonucleotide
aaaaugaccacucuuuuaauugaaa

SEQ ID NO: 3661 - DNA, 25 bp, Artificial Sequence
  Description of Artificial Sequence: Synthetic oligonucleotide
  Description of Combined DNA/RNA Molecule: Synthetic oligonucleotide
aaaugaccacucuuuuaauugaaat

SEQ ID NO: 3662 - DNA, 25 bp, Artificial Sequence
  Description of Artificial Sequence: Synthetic oligonucleotide
  Description of Combined DNA/RNA Molecule: Synthetic oligonucleotide
cucuuuuaauugaaauuaacuuuta

SEQ ID NO: 3663 - RNA, 25 nt, Artificial Sequence
  Description of Artificial Sequence: Synthetic oligonucleotide
ucuuuuaauugaaauuaacuuuuaa

SEQ ID NO: 3664 - DNA, 25 bp, Artificial Sequence
  Description of Artificial Sequence: Synthetic oligonucleotide
  Description of Combined DNA/RNA Molecule: Synthetic oligonucleotide
uuuuaauugaaauuaacuuuuaaat

SEQ ID NO: 3665 - DNA, 25 bp, Artificial Sequence
  Description of Artificial Sequence: Synthetic oligonucleotide
  Description of Combined DNA/RNA Molecule: Synthetic oligonucleotide
uuaauugaaauuaacuuuuaaaugt

SEQ ID NO: 3666 - DNA, 25 bp, Artificial Sequence
  Description of Artificial Sequence: Synthetic oligonucleotide
  Description of Combined DNA/RNA Molecule: Synthetic oligonucleotide
uaauugaaauuaacuuuuaaaugtt

SEQ ID NO: 3667 - DNA, 25 bp, Artificial Sequence
  Description of Artificial Sequence: Synthetic oligonucleotide
  Description of Combined DNA/RNA Molecule: Synthetic oligonucleotide
aauugaaauuaacuuuuaaaugutt

SEQ ID NO: 3668 - DNA, 25 bp, Artificial Sequence
  Description of Artificial Sequence: Synthetic oligonucleotide
  Description of Combined DNA/RNA Molecule: Synthetic oligonucleotide
auugaaauuaacuuuuaaauguuta

SEQ ID NO: 3669 - DNA, 25 bp, Artificial Sequence
  Description of Artificial Sequence: Synthetic oligonucleotide
  Description of Combined DNA/RNA Molecule: Synthetic oligonucleotide
uugaaauuaacuuuuaaauguuuat

SEQ ID NO: 3670 - DNA, 25 bp, Artificial Sequence
  Description of Artificial Sequence: Synthetic oligonucleotide
  Description of Combined DNA/RNA Molecule: Synthetic oligonucleotide
ugaaauuaacuuuuaaauguuuata

SEQ ID NO: 3671 - RNA, 25 nt, Artificial Sequence
  Description of Artificial Sequence: Synthetic oligonucleotide
aauuaacuuuuaaauguuuauagga

SEQ ID NO: 3672 - DNA, 25 bp, Artificial Sequence
  Description of Artificial Sequence: Synthetic oligonucleotide
  Description of Combined DNA/RNA Molecule: Synthetic oligonucleotide
aacuuuuaaauguuuauaggaguat

SEQ ID NO: 3673 - RNA, 25 nt, Artificial Sequence
  Description of Artificial Sequence: Synthetic oligonucleotide
uuuaaauguuuauaggaguaugugc

SEQ ID NO: 3674 - DNA, 25 bp, Artificial Sequence
  Description of Artificial Sequence: Synthetic oligonucleotide
  Description of Combined DNA/RNA Molecule: Synthetic oligonucleotide
uuaaauguuuauaggaguaugugct

SEQ ID NO: 3675 - DNA, 25 bp, Artificial Sequence
  Description of Artificial Sequence: Synthetic oligonucleotide
  Description of Combined DNA/RNA Molecule: Synthetic oligonucleotide
gcugugaagugaucuaaaauuugta

SEQ ID NO: 3676 - DNA, 25 bp, Artificial Sequence
  Description of Artificial Sequence: Synthetic oligonucleotide
  Description of Combined DNA/RNA Molecule: Synthetic oligonucleotide
ugugaagugaucuaaaauuuguaat

SEQ ID NO: 3677 - DNA, 25 bp, Artificial Sequence
  Description of Artificial Sequence: Synthetic oligonucleotide
  Description of Combined DNA/RNA Molecule: Synthetic oligonucleotide
gugaagugaucuaaaauuuguaata

SEQ ID NO: 3678 - DNA, 25 bp, Artificial Sequence
  Description of Artificial Sequence: Synthetic oligonucleotide
  Description of Combined DNA/RNA Molecule: Synthetic oligonucleotide
ugaagugaucuaaaauuuguaauat

SEQ ID NO: 3679 - DNA, 25 bp, Artificial Sequence
  Description of Artificial Sequence: Synthetic oligonucleotide
  Description of Combined DNA/RNA Molecule: Synthetic oligonucleotide
gaagugaucuaaaauuuguaauatt

SEQ ID NO: 3680 - DNA, 25 bp, Artificial Sequence
  Description of Artificial Sequence: Synthetic oligonucleotide
  Description of Combined DNA/RNA Molecule: Synthetic oligonucleotide
aagugaucuaaaauuuguaauautt

SEQ ID NO: 3681 - DNA, 25 bp, Artificial Sequence
  Description of Artificial Sequence: Synthetic oligonucleotide
  Description of Combined DNA/RNA Molecule: Synthetic oligonucleotide
agugaucuaaaauuuguaauauutt

SEQ ID NO: 3682 - DNA, 25 bp, Artificial Sequence
  Description of Artificial Sequence: Synthetic oligonucleotide
  Description of Combined DNA/RNA Molecule: Synthetic oligonucleotide
aucuaaaauuuguaauauuuuugtc

SEQ ID NO: 3683 - RNA, 25 nt, Artificial Sequence
  Description of Artificial Sequence: Synthetic oligonucleotide
ucuaaaauuuguaauauuuuuguca

SEQ ID NO: 3684 - RNA, 25 nt, Artificial Sequence
  Description of Artificial Sequence: Synthetic oligonucleotide
aaauuuguaauauuuuugucaugaa

SEQ ID NO: 3685 - RNA, 25 nt, Artificial Sequence
  Description of Artificial Sequence: Synthetic oligonucleotide
aauuuguaauauuuuugucaugaac

SEQ ID NO: 3686 - DNA, 25 bp, Artificial Sequence
  Description of Artificial Sequence: Synthetic oligonucleotide
  Description of Combined DNA/RNA Molecule: Synthetic oligonucleotide
auuuguaauauuuuugucaugaact

SEQ ID NO: 3687 - RNA, 25 nt, Artificial Sequence
  Description of Artificial Sequence: Synthetic oligonucleotide
guaauauuuuugucaugaacuguac

SEQ ID NO: 3688 - DNA, 25 bp, Artificial Sequence
  Description of Artificial Sequence: Synthetic oligonucleotide
  Description of Combined DNA/RNA Molecule: Synthetic oligonucleotide
uaauauuuuugucaugaacuguact

SEQ ID NO: 3689 - DNA, 25 bp, Artificial Sequence
  Description of Artificial Sequence: Synthetic oligonucleotide
  Description of Combined DNA/RNA Molecule: Synthetic oligonucleotide
aacuguacuacuccuaauuauugta

SEQ ID NO: 3690 - RNA, 25 nt, Artificial Sequence
  Description of Artificial Sequence: Synthetic oligonucleotide
acuguacuacuccuaauuauuguaa

SEQ ID NO: 3691 - RNA, 25 nt, Artificial Sequence
  Description of Artificial Sequence: Synthetic oligonucleotide
uccuaauuauuguaauguaauaaaa

SEQ ID NO: 3692 - RNA, 25 nt, Artificial Sequence
  Description of Artificial Sequence: Synthetic oligonucleotide
ccuaauuauuguaauguaauaaaaa

SEQ ID NO: 3693 - DNA, 25 bp, Artificial Sequence
  Description of Artificial Sequence: Synthetic oligonucleotide
  Description of Combined DNA/RNA Molecule: Synthetic oligonucleotide
uaauuauuguaauguaauaaaaata

SEQ ID NO: 3694 - DNA, 25 bp, Artificial Sequence
  Description of Artificial Sequence: Synthetic oligonucleotide
  Description of Combined DNA/RNA Molecule: Synthetic oligonucleotide
auuauuguaauguaauaaaaauagt

SEQ ID NO: 3695 - DNA, 25 bp, Artificial Sequence
  Description of Artificial Sequence: Synthetic oligonucleotide
  Description of Combined DNA/RNA Molecule: Synthetic oligonucleotide
uuauuguaauguaauaaaaauagtt

SEQ ID NO: 3696 - RNA, 25 nt, Artificial Sequence
  Description of Artificial Sequence: Synthetic oligonucleotide
auuguaauguaauaaaaauaguuac

SEQ ID NO: 3697 - RNA, 25 nt, Artificial Sequence
  Description of Artificial Sequence: Synthetic oligonucleotide
uuguaauguaauaaaaauaguuaca

SEQ ID NO: 3698 - RNA, 25 nt, Artificial Sequence
  Description of Artificial Sequence: Synthetic oligonucleotide
aauguaauaaaaauaguuacaguga

SEQ ID NO: 3699 - RNA, 25 nt, Artificial Sequence
  Description of Artificial Sequence: Synthetic oligonucleotide
auguaauaaaaauaguuacagugac

SEQ ID NO: 3700 - RNA, 25 nt, Artificial Sequence
  Description of Artificial Sequence: Synthetic oligonucleotide
uguaauaaaaauaguuacagugaca

SEQ ID NO: 3701 - RNA, 25 nt, Artificial Sequence
  Description of Artificial Sequence: Synthetic oligonucleotide
aaauaguuacagugacaaaaaaaaa

SEQ ID NO: 3702 - RNA, 25 nt, Artificial Sequence
  Description of Artificial Sequence: Synthetic oligonucleotide
aauaguuacagugacaaaaaaaaaa

SEQ ID NO: 3703 - RNA, 25 nt, Artificial Sequence
  Description of Artificial Sequence: Synthetic oligonucleotide
uaguuacagugacaaaaaaaaaaaa

SEQ ID NO: 3704 - DNA, 27 bp, Homo sapiens
cctgctgaaaatgactgaatataaact

SEQ ID NO: 3705 - DNA, 27 bp, Homo sapiens
gaaaatgactgaatataaacttgtggt

SEQ ID NO: 3706 - DNA, 27 bp, Homo sapiens
atgactgaatataaacttgtggtagtt

SEQ ID NO: 3707 - DNA, 27 bp, Homo sapiens
acagctaattcagaatcattttgtgga

SEQ ID NO: 3708 - DNA, 27 bp, Homo sapiens
ggacgaatatgatccaacaatagagga

SEQ ID NO: 3709 - DNA, 27 bp, Homo sapiens
gaagcaagtagtaattgatggagaaac

SEQ ID NO: 3710 - DNA, 27 bp, Homo sapiens
ggggagggctttctttgtgtatttgcc

SEQ ID NO: 3711 - DNA, 27 bp, Homo sapiens
tttctttgtgtatttgccataaataat

SEQ ID NO: 3712 - DNA, 27 bp, Homo sapiens
ttctttgtgtatttgccataaataata

SEQ ID NO: 3713 - DNA, 27 bp, Homo sapiens
tctttgtgtatttgccataaataatac

SEQ ID NO: 3714 - DNA, 27 bp, Homo sapiens
ctttgtgtatttgccataaataatact

SEQ ID NO: 3715 - DNA, 27 bp, Homo sapiens
gtgtatttgccataaataatactaaat

SEQ ID NO: 3716 - DNA, 27 bp, Homo sapiens
tgtatttgccataaataatactaaatc

SEQ ID NO: 3717 - DNA, 27 bp, Homo sapiens
tgccataaataatactaaatcatttga

SEQ ID NO: 3718 - DNA, 27 bp, Homo sapiens
gccataaataatactaaatcatttgaa

SEQ ID NO: 3719 - DNA, 27 bp, Homo sapiens
cataaataatactaaatcatttgaaga

SEQ ID NO: 3720 - DNA, 27 bp, Homo sapiens
ataaataatactaaatcatttgaagat

SEQ ID NO: 3721 - DNA, 27 bp, Homo sapiens
taaataatactaaatcatttgaagata

SEQ ID NO: 3722 - DNA, 27 bp, Homo sapiens
aaataatactaaatcatttgaagatat

SEQ ID NO: 3723 - DNA, 27 bp, Homo sapiens
tcatttgaagatattcaccattataga

SEQ ID NO: 3724 - DNA, 27 bp, Homo sapiens
atttgaagatattcaccattatagaga

SEQ ID NO: 3725 - DNA, 27 bp, Homo sapiens
tttgaagatattcaccattatagagaa

SEQ ID NO: 3726 - DNA, 27 bp, Homo sapiens
ttgaagatattcaccattatagagaac

SEQ ID NO: 3727 - DNA, 27 bp, Homo sapiens
tgaagatattcaccattatagagaaca

SEQ ID NO: 3728 - DNA, 27 bp, Homo sapiens
caccattatagagaacaaattaaaaga

SEQ ID NO: 3729 - DNA, 27 bp, Homo sapiens
ccattatagagaacaaattaaaagagt

SEQ ID NO: 3730 - DNA, 27 bp, Homo sapiens
cattatagagaacaaattaaaagagtt

SEQ ID NO: 3731 - DNA, 27 bp, Homo sapiens
attatagagaacaaattaaaagagtta

SEQ ID NO: 3732 - DNA, 27 bp, Homo sapiens
ttatagagaacaaattaaaagagttaa

SEQ ID NO: 3733 - DNA, 27 bp, Homo sapiens
tcctagtaggaaataaatgtgatttgc

SEQ ID NO: 3734 - DNA, 27 bp, Homo sapiens
cctagtaggaaataaatgtgatttgcc

SEQ ID NO: 3735 - DNA, 27 bp, Homo sapiens
gcaagaagttatggaattccttttatt

SEQ ID NO: 3736 - DNA, 27 bp, Homo sapiens
agaagttatggaattccttttattgaa

SEQ ID NO: 3737 - DNA, 27 bp, Homo sapiens
gaagttatggaattccttttattgaaa

SEQ ID NO: 3738 - DNA, 27 bp, Homo sapiens
aagttatggaattccttttattgaaac

SEQ ID NO: 3739 - DNA, 27 bp, Homo sapiens
agttatggaattccttttattgaaaca

SEQ ID NO: 3740 - DNA, 27 bp, Homo sapiens
agtggaggatgctttttatacattggt

SEQ ID NO: 3741 - DNA, 27 bp, Homo sapiens
tggaggatgctttttatacattggtga

SEQ ID NO: 3742 - DNA, 27 bp, Homo sapiens
atacagattgaaaaaaatcagcaaaga

SEQ ID NO: 3743 - DNA, 27 bp, Homo sapiens
tacagattgaaaaaaatcagcaaagaa

SEQ ID NO: 3744 - DNA, 27 bp, Homo sapiens
cagattgaaaaaaatcagcaaagaaga

SEQ ID NO: 3745 - DNA, 27 bp, Homo sapiens
agattgaaaaaaatcagcaaagaagaa

SEQ ID NO: 3746 - DNA, 27 bp, Homo sapiens
gattgaaaaaaatcagcaaagaagaaa

SEQ ID NO: 3747 - DNA, 27 bp, Homo sapiens
attgaaaaaaatcagcaaagaagaaaa

SEQ ID NO: 3748 - DNA, 27 bp, Homo sapiens
actcctggctgtgtgaaaattaaaaaa

SEQ ID NO: 3749 - DNA, 27 bp, Homo sapiens
ctggctgtgtgaaaattaaaaaatgca

SEQ ID NO: 3750 - DNA, 27 bp, Homo sapiens
ctgtgtgaaaattaaaaaatgcattat

SEQ ID NO: 3751 - DNA, 27 bp, Homo sapiens
tgtgtgaaaattaaaaaatgcattata

SEQ ID NO: 3752 - DNA, 27 bp, Homo sapiens
gtgtgaaaattaaaaaatgcattataa

SEQ ID NO: 3753 - DNA, 27 bp, Homo sapiens
tgtgaaaattaaaaaatgcattataat

SEQ ID NO: 3754 - DNA, 27 bp, Homo sapiens
tgaaaattaaaaaatgcattataatgt

SEQ ID NO: 3755 - DNA, 27 bp, Homo sapiens
gaaaattaaaaaatgcattataatgta

SEQ ID NO: 3756 - DNA, 27 bp, Homo sapiens
aaaattaaaaaatgcattataatgtaa

SEQ ID NO: 3757 - DNA, 27 bp, Homo sapiens
aaattaaaaaatgcattataatgtaat

SEQ ID NO: 3758 - DNA, 27 bp, Homo sapiens
attaaaaaatgcattataatgtaatct

SEQ ID NO: 3759 - DNA, 27 bp, Homo sapiens
aatgcattataatgtaatctgggtgtt

SEQ ID NO: 3760 - DNA, 27 bp, Homo sapiens
agttcgagaaattcgaaaacataaaga

SEQ ID NO: 3761 - DNA, 27 bp, Homo sapiens
gttcgagaaattcgaaaacataaagaa

SEQ ID NO: 3762 - DNA, 27 bp, Homo sapiens
ttcgagaaattcgaaaacataaagaaa

SEQ ID NO: 3763 - DNA, 27 bp, Homo sapiens
gagaaattcgaaaacataaagaaaaga

SEQ ID NO: 3764 - DNA, 27 bp, Homo sapiens
attcgaaaacataaagaaaagatgagc

SEQ ID NO: 3765 - DNA, 27 bp, Homo sapiens
ttcgaaaacataaagaaaagatgagca

SEQ ID NO: 3766 - DNA, 27 bp, Homo sapiens
gcaaagatggtaaaaagaagaaaaaga

SEQ ID NO: 3767 - DNA, 27 bp, Homo sapiens
caaagatggtaaaaagaagaaaaagaa

SEQ ID NO: 3768 - DNA, 27 bp, Homo sapiens
aagatggtaaaaagaagaaaaagaagt

SEQ ID NO: 3769 - DNA, 27 bp, Homo sapiens
agatggtaaaaagaagaaaaagaagtc

SEQ ID NO: 3770 - DNA, 27 bp, Homo sapiens
gtaaaaagaagaaaaagaagtcaaaga

SEQ ID NO: 3771 - DNA, 27 bp, Homo sapiens
taaaaagaagaaaaagaagtcaaagac

SEQ ID NO: 3772 - DNA, 27 bp, Homo sapiens
aaaaagaagaaaaagaagtcaaagaca

SEQ ID NO: 3773 - DNA, 27 bp, Homo sapiens
agtcaaagacaaagtgtgtaattatgt

SEQ ID NO: 3774 - DNA, 27 bp, Homo sapiens
gtcaaagacaaagtgtgtaattatgta

SEQ ID NO: 3775 - DNA, 27 bp, Homo sapiens
aagacaaagtgtgtaattatgtaaata

SEQ ID NO: 3776 - DNA, 27 bp, Homo sapiens
gacaaagtgtgtaattatgtaaataca

SEQ ID NO: 3777 - DNA, 27 bp, Homo sapiens
aagtgtgtaattatgtaaatacaattt

SEQ ID NO: 3778 - DNA, 27 bp, Homo sapiens
gtgtgtaattatgtaaatacaatttgt

SEQ ID NO: 3779 - DNA, 27 bp, Homo sapiens
gtgtaattatgtaaatacaatttgtac

SEQ ID NO: 3780 - DNA, 27 bp, Homo sapiens
tgtaattatgtaaatacaatttgtact

SEQ ID NO: 3781 - DNA, 27 bp, Homo sapiens
attatgtaaatacaatttgtacttttt

SEQ ID NO: 3782 - DNA, 27 bp, Homo sapiens
ttatgtaaatacaatttgtactttttt

SEQ ID NO: 3783 - DNA, 27 bp, Homo sapiens
tatgtaaatacaatttgtacttttttc

SEQ ID NO: 3784 - DNA, 27 bp, Homo sapiens
atgtaaatacaatttgtacttttttct

SEQ ID NO: 3785 - DNA, 27 bp, Homo sapiens
atacaatttgtacttttttcttaaggc

SEQ ID NO: 3786 - DNA, 27 bp, Homo sapiens
tacaatttgtacttttttcttaaggca

SEQ ID NO: 3787 - DNA, 27 bp, Homo sapiens
catactagtacaagtggtaatttttgt

SEQ ID NO: 3788 - DNA, 27 bp, Homo sapiens
atactagtacaagtggtaatttttgta

SEQ ID NO: 3789 - DNA, 27 bp, Homo sapiens
gtacaagtggtaatttttgtacattac

SEQ ID NO: 3790 - DNA, 27 bp, Homo sapiens
tacaagtggtaatttttgtacattaca

SEQ ID NO: 3791 - DNA, 27 bp, Homo sapiens
ggtaatttttgtacattacactaaatt

SEQ ID NO: 3792 - DNA, 27 bp, Homo sapiens
gtaatttttgtacattacactaaatta

SEQ ID NO: 3793 - DNA, 27 bp, Homo sapiens
taatttttgtacattacactaaattat

SEQ ID NO: 3794 - DNA, 27 bp, Homo sapiens
aatttttgtacattacactaaattatt

SEQ ID NO: 3795 - DNA, 27 bp, Homo sapiens
atttttgtacattacactaaattatta

SEQ ID NO: 3796 - DNA, 27 bp, Homo sapiens
tacactaaattattagcatttgtttta

SEQ ID NO: 3797 - DNA, 27 bp, Homo sapiens
cactaaattattagcatttgttttagc

SEQ ID NO: 3798 - DNA, 27 bp, Homo sapiens
actaaattattagcatttgttttagca

SEQ ID NO: 3799 - DNA, 27 bp, Homo sapiens
attattagcatttgttttagcattacc

SEQ ID NO: 3800 - DNA, 27 bp, Homo sapiens
agcatttgttttagcattacctaattt

SEQ ID NO: 3801 - DNA, 27 bp, Homo sapiens
gcatttgttttagcattacctaatttt

SEQ ID NO: 3802 - DNA, 27 bp, Homo sapiens
atttgttttagcattacctaatttttt

SEQ ID NO: 3803 - DNA, 27 bp, Homo sapiens
tttgttttagcattacctaattttttt

SEQ ID NO: 3804 - DNA, 27 bp, Homo sapiens
ttgttttagcattacctaatttttttc

SEQ ID NO: 3805 - DNA, 27 bp, Homo sapiens
tgttttagcattacctaatttttttcc

SEQ ID NO: 3806 - DNA, 27 bp, Homo sapiens
cagactgttagcttttaccttaaatgc

SEQ ID NO: 3807 - DNA, 27 bp, Homo sapiens
agactgttagcttttaccttaaatgct

SEQ ID NO: 3808 - DNA, 27 bp, Homo sapiens
ttagcttttaccttaaatgcttatttt

SEQ ID NO: 3809 - DNA, 27 bp, Homo sapiens
tagcttttaccttaaatgcttatttta

SEQ ID NO: 3810 - DNA, 27 bp, Homo sapiens
agcttttaccttaaatgcttattttaa

SEQ ID NO: 3811 - DNA, 27 bp, Homo sapiens
taccttaaatgcttattttaaaatgac

SEQ ID NO: 3812 - DNA, 27 bp, Homo sapiens
accttaaatgcttattttaaaatgaca

SEQ ID NO: 3813 - DNA, 27 bp, Homo sapiens
aatgcttattttaaaatgacagtggaa

SEQ ID NO: 3814 - DNA, 27 bp, Homo sapiens
tgcttattttaaaatgacagtggaagt

SEQ ID NO: 3815 - DNA, 27 bp, Homo sapiens
cagtggaagtttttttttcctctaagt

SEQ ID NO: 3816 - DNA, 27 bp, Homo sapiens
gtggaagtttttttttcctctaagtgc

SEQ ID NO: 3817 - DNA, 27 bp, Homo sapiens
tggaagtttttttttcctctaagtgcc

SEQ ID NO: 3818 - DNA, 27 bp, Homo sapiens
agttttggtttttgaactagcaatgcc

SEQ ID NO: 3819 - DNA, 27 bp, Homo sapiens
atgcctgtgaaaaagaaactgaatacc

SEQ ID NO: 3820 - DNA, 27 bp, Homo sapiens
tgaaaaagaaactgaatacctaagatt

SEQ ID NO: 3821 - DNA, 27 bp, Homo sapiens
gaaaaagaaactgaatacctaagattt

SEQ ID NO: 3822 - DNA, 27 bp, Homo sapiens
gaaactgaatacctaagatttctgtct

SEQ ID NO: 3823 - DNA, 27 bp, Homo sapiens
catgcagttgattacttcttatttttc

SEQ ID NO: 3824 - DNA, 27 bp, Homo sapiens
atgcagttgattacttcttatttttct

SEQ ID NO: 3825 - DNA, 27 bp, Homo sapiens
agttgattacttcttatttttcttacc

SEQ ID NO: 3826 - DNA, 27 bp, Homo sapiens
acttcttatttttcttaccaattgtga

SEQ ID NO: 3827 - DNA, 27 bp, Homo sapiens
cttcttatttttcttaccaattgtgaa

SEQ ID NO: 3828 - DNA, 27 bp, Homo sapiens
ttcttatttttcttaccaattgtgaat

SEQ ID NO: 3829 - DNA, 27 bp, Homo sapiens
gaatgttggtgtgaaacaaattaatga

SEQ ID NO: 3830 - DNA, 27 bp, Homo sapiens
tgttggtgtgaaacaaattaatgaagc

SEQ ID NO: 3831 - DNA, 27 bp, Homo sapiens
gttggtgtgaaacaaattaatgaagct

SEQ ID NO: 3832 - DNA, 27 bp, Homo sapiens
gaaacaaattaatgaagcttttgaatc

SEQ ID NO: 3833 - DNA, 27 bp, Homo sapiens
aaacaaattaatgaagcttttgaatca

SEQ ID NO: 3834 - DNA, 27 bp, Homo sapiens
attctgtgttttatctagtcacataaa

SEQ ID NO: 3835 - DNA, 27 bp, Homo sapiens
ttctgtgttttatctagtcacataaat

SEQ ID NO: 3836 - DNA, 27 bp, Homo sapiens
tgtgttttatctagtcacataaatgga

SEQ ID NO: 3837 - DNA, 27 bp, Homo sapiens
gtgttttatctagtcacataaatggat

SEQ ID NO: 3838 - DNA, 27 bp, Homo sapiens
ttatctagtcacataaatggattaatt

SEQ ID NO: 3839 - DNA, 27 bp, Homo sapiens
tatctagtcacataaatggattaatta

SEQ ID NO: 3840 - DNA, 27 bp, Homo sapiens
cacataaatggattaattactaatttc

SEQ ID NO: 3841 - DNA, 27 bp, Homo sapiens
acataaatggattaattactaatttca

SEQ ID NO: 3842 - DNA, 27 bp, Homo sapiens
aatggattaattactaatttcagttga

SEQ ID NO: 3843 - DNA, 27 bp, Homo sapiens
tggattaattactaatttcagttgaga

SEQ ID NO: 3844 - DNA, 27 bp, Homo sapiens
ggattaattactaatttcagttgagac

SEQ ID NO: 3845 - DNA, 27 bp, Homo sapiens
gattaattactaatttcagttgagacc

SEQ ID NO: 3846 - DNA, 27 bp, Homo sapiens
tctaattggtttttactgaaacattga

SEQ ID NO: 3847 - DNA, 27 bp, Homo sapiens
attggtttttactgaaacattgaggga

SEQ ID NO: 3848 - DNA, 27 bp, Homo sapiens
ttggtttttactgaaacattgagggaa

SEQ ID NO: 3849 - DNA, 27 bp, Homo sapiens
acattgagggaacacaaatttatgggc

SEQ ID NO: 3850 - DNA, 27 bp, Homo sapiens
cattgagggaacacaaatttatgggct

SEQ ID NO: 3851 - DNA, 27 bp, Homo sapiens
cctgatgaatgtaaagttacactgttc

SEQ ID NO: 3852 - DNA, 27 bp, Homo sapiens
ctgatgaatgtaaagttacactgttca

SEQ ID NO: 3853 - DNA, 27 bp, Homo sapiens
ccccaaaatattatattttttctataa

SEQ ID NO: 3854 - DNA, 27 bp, Homo sapiens
cccaaaatattatattttttctataaa

SEQ ID NO: 3855 - DNA, 27 bp, Homo sapiens
ccaaaatattatattttttctataaaa

SEQ ID NO: 3856 - DNA, 27 bp, Homo sapiens
caaaatattatattttttctataaaaa

SEQ ID NO: 3857 - DNA, 27 bp, Homo sapiens
aaatattatattttttctataaaaaga

SEQ ID NO: 3858 - DNA, 27 bp, Homo sapiens
aatattatattttttctataaaaagaa

SEQ ID NO: 3859 - DNA, 27 bp, Homo sapiens
atattatattttttctataaaaagaaa

SEQ ID NO: 3860 - DNA, 27 bp, Homo sapiens
tattatattttttctataaaaagaaaa

SEQ ID NO: 3861 - DNA, 27 bp, Homo sapiens
attatattttttctataaaaagaaaaa

SEQ ID NO: 3862 - DNA, 27 bp, Homo sapiens
ttatattttttctataaaaagaaaaaa

SEQ ID NO: 3863 - DNA, 27 bp, Homo sapiens
tatattttttctataaaaagaaaaaaa

SEQ ID NO: 3864 - DNA, 27 bp, Homo sapiens
atattttttctataaaaagaaaaaaat

SEQ ID NO: 3865 - DNA, 27 bp, Homo sapiens
ttttctataaaaagaaaaaaatggaaa

SEQ ID NO: 3866 - DNA, 27 bp, Homo sapiens
tttctataaaaagaaaaaaatggaaaa

SEQ ID NO: 3867 - DNA, 27 bp, Homo sapiens
tctataaaaagaaaaaaatggaaaaaa

SEQ ID NO: 3868 - DNA, 27 bp, Homo sapiens
ctataaaaagaaaaaaatggaaaaaaa

SEQ ID NO: 3869 - DNA, 27 bp, Homo sapiens
tataaaaagaaaaaaatggaaaaaaat

SEQ ID NO: 3870 - DNA, 27 bp, Homo sapiens
ataaaaagaaaaaaatggaaaaaaatt

SEQ ID NO: 3871 - DNA, 27 bp, Homo sapiens
taaaaagaaaaaaatggaaaaaaatta

SEQ ID NO: 3872 - DNA, 27 bp, Homo sapiens
aaaaagaaaaaaatggaaaaaaattac

SEQ ID NO: 3873 - DNA, 27 bp, Homo sapiens
aaaagaaaaaaatggaaaaaaattaca

SEQ ID NO: 3874 - DNA, 27 bp, Homo sapiens
gaaaaaaatggaaaaaaattacaaggc

SEQ ID NO: 3875 - DNA, 27 bp, Homo sapiens
aaaaaaatggaaaaaaattacaaggca

SEQ ID NO: 3876 - DNA, 27 bp, Homo sapiens
aatggaaaaaaattacaaggcaatgga

SEQ ID NO: 3877 - DNA, 27 bp, Homo sapiens
atggaaaaaaattacaaggcaatggaa

SEQ ID NO: 3878 - DNA, 27 bp, Homo sapiens
tggaaaaaaattacaaggcaatggaaa

SEQ ID NO: 3879 - DNA, 27 bp, Homo sapiens
aggccatttccttttcacattagataa

SEQ ID NO: 3880 - DNA, 27 bp, Homo sapiens
tttccttttcacattagataaattact

SEQ ID NO: 3881 - DNA, 27 bp, Homo sapiens
ttcacattagataaattactataaaga

SEQ ID NO: 3882 - DNA, 27 bp, Homo sapiens
tcacattagataaattactataaagac

SEQ ID NO: 3883 - DNA, 27 bp, Homo sapiens
cacattagataaattactataaagact

SEQ ID NO: 3884 - DNA, 27 bp, Homo sapiens
ccagtatgaaatggggattattatagc

SEQ ID NO: 3885 - DNA, 27 bp, Homo sapiens
aatggggattattatagcaaccatttt

SEQ ID NO: 3886 - DNA, 27 bp, Homo sapiens
ggggctatatttacatgctactaaatt

SEQ ID NO: 3887 - DNA, 27 bp, Homo sapiens
gggctatatttacatgctactaaattt

SEQ ID NO: 3888 - DNA, 27 bp, Homo sapiens
ggctatatttacatgctactaaatttt

SEQ ID NO: 3889 - DNA, 27 bp, Homo sapiens
gctatatttacatgctactaaattttt

SEQ ID NO: 3890 - DNA, 27 bp, Homo sapiens
ctatatttacatgctactaaattttta

SEQ ID NO: 3891 - DNA, 27 bp, Homo sapiens
tttacatgctactaaatttttataata

SEQ ID NO: 3892 - DNA, 27 bp, Homo sapiens
gctactaaatttttataataattgaaa

SEQ ID NO: 3893 - DNA, 27 bp, Homo sapiens
ctactaaatttttataataattgaaaa

SEQ ID NO: 3894 - DNA, 27 bp, Homo sapiens
actaaatttttataataattgaaaaga

SEQ ID NO: 3895 - DNA, 27 bp, Homo sapiens
ctaaatttttataataattgaaaagat

SEQ ID NO: 3896 - DNA, 27 bp, Homo sapiens
taaatttttataataattgaaaagatt

SEQ ID NO: 3897 - DNA, 27 bp, Homo sapiens
aaatttttataataattgaaaagattt

SEQ ID NO: 3898 - DNA, 27 bp, Homo sapiens
aatttttataataattgaaaagatttt

SEQ ID NO: 3899 - DNA, 27 bp, Homo sapiens
atttttataataattgaaaagatttta

SEQ ID NO: 3900 - DNA, 27 bp, Homo sapiens
tttttataataattgaaaagattttaa

SEQ ID NO: 3901 - DNA, 27 bp, Homo sapiens
ttttataataattgaaaagattttaac

SEQ ID NO: 3902 - DNA, 27 bp, Homo sapiens
tttataataattgaaaagattttaaca

SEQ ID NO: 3903 - DNA, 27 bp, Homo sapiens
taataattgaaaagattttaacaagta

SEQ ID NO: 3904 - DNA, 27 bp, Homo sapiens
aataattgaaaagattttaacaagtat

SEQ ID NO: 3905 - DNA, 27 bp, Homo sapiens
taattgaaaagattttaacaagtataa

SEQ ID NO: 3906 - DNA, 27 bp, Homo sapiens
aattgaaaagattttaacaagtataaa

SEQ ID NO: 3907 - DNA, 27 bp, Homo sapiens
attgaaaagattttaacaagtataaaa

SEQ ID NO: 3908 - DNA, 27 bp, Homo sapiens
ttgaaaagattttaacaagtataaaaa

SEQ ID NO: 3909 - DNA, 27 bp, Homo sapiens
tgaaaagattttaacaagtataaaaaa

SEQ ID NO: 3910 - DNA, 27 bp, Homo sapiens
gaaaagattttaacaagtataaaaaat

SEQ ID NO: 3911 - DNA, 27 bp, Homo sapiens
aaaagattttaacaagtataaaaaatt

SEQ ID NO: 3912 - DNA, 27 bp, Homo sapiens
aaagattttaacaagtataaaaaattc

SEQ ID NO: 3913 - DNA, 27 bp, Homo sapiens
aagattttaacaagtataaaaaattct

SEQ ID NO: 3914 - DNA, 27 bp, Homo sapiens
taacaagtataaaaaattctcatagga

SEQ ID NO: 3915 - DNA, 27 bp, Homo sapiens
aacaagtataaaaaattctcataggaa

SEQ ID NO: 3916 - DNA, 27 bp, Homo sapiens
acaagtataaaaaattctcataggaat

SEQ ID NO: 3917 - DNA, 27 bp, Homo sapiens
caagtataaaaaattctcataggaatt

SEQ ID NO: 3918 - DNA, 27 bp, Homo sapiens
aagtataaaaaattctcataggaatta

SEQ ID NO: 3919 - DNA, 27 bp, Homo sapiens
agtataaaaaattctcataggaattaa

SEQ ID NO: 3920 - DNA, 27 bp, Homo sapiens
gtataaaaaattctcataggaattaaa

SEQ ID NO: 3921 - DNA, 27 bp, Homo sapiens
tataaaaaattctcataggaattaaat

SEQ ID NO: 3922 - DNA, 27 bp, Homo sapiens
taaaaaattctcataggaattaaatgt

SEQ ID NO: 3923 - DNA, 27 bp, Homo sapiens
aaaaaattctcataggaattaaatgta

SEQ ID NO: 3924 - DNA, 27 bp, Homo sapiens
tgctctttcatagtataactttaaatc

SEQ ID NO: 3925 - DNA, 27 bp, Homo sapiens
tttcatagtataactttaaatcttttc

SEQ ID NO: 3926 - DNA, 27 bp, Homo sapiens
ttcatagtataactttaaatcttttct

SEQ ID NO: 3927 - DNA, 27 bp, Homo sapiens
actttaaatcttttcttcaacttgagt

SEQ ID NO: 3928 - DNA, 27 bp, Homo sapiens
ctttaaatcttttcttcaacttgagtc

SEQ ID NO: 3929 - DNA, 27 bp, Homo sapiens
tcaacttgagtctttgaagatagtttt

SEQ ID NO: 3930 - DNA, 27 bp, Homo sapiens
aacttgagtctttgaagatagttttaa

SEQ ID NO: 3931 - DNA, 27 bp, Homo sapiens
acttgagtctttgaagatagttttaat

SEQ ID NO: 3932 - DNA, 27 bp, Homo sapiens
tgaagatagttttaattctgcttgtga

SEQ ID NO: 3933 - DNA, 27 bp, Homo sapiens
gaagatagttttaattctgcttgtgac

SEQ ID NO: 3934 - DNA, 27 bp, Homo sapiens
aagatagttttaattctgcttgtgaca

SEQ ID NO: 3935 - DNA, 27 bp, Homo sapiens
tctgcttgtgacattaaaagattattt

SEQ ID NO: 3936 - DNA, 27 bp, Homo sapiens
agagcattgcttttgtttcttaagaaa

SEQ ID NO: 3937 - DNA, 27 bp, Homo sapiens
gagcattgcttttgtttcttaagaaaa

SEQ ID NO: 3938 - DNA, 27 bp, Homo sapiens
tgcttttgtttcttaagaaaacaaact

SEQ ID NO: 3939 - DNA, 27 bp, Homo sapiens
gtttcttaagaaaacaaactctttttt

SEQ ID NO: 3940 - DNA, 27 bp, Homo sapiens
tttcttaagaaaacaaactctttttta

SEQ ID NO: 3941 - DNA, 27 bp, Homo sapiens
ttcttaagaaaacaaactcttttttaa

SEQ ID NO: 3942 - DNA, 27 bp, Homo sapiens
tcttaagaaaacaaactcttttttaaa

SEQ ID NO: 3943 - DNA, 27 bp, Homo sapiens
cttaagaaaacaaactcttttttaaaa

SEQ ID NO: 3944 - DNA, 27 bp, Homo sapiens
ttaagaaaacaaactcttttttaaaaa

SEQ ID NO: 3945 - DNA, 27 bp, Homo sapiens
taagaaaacaaactcttttttaaaaat

SEQ ID NO: 3946 - DNA, 27 bp, Homo sapiens
aaaacaaactcttttttaaaaattact

SEQ ID NO: 3947 - DNA, 27 bp, Homo sapiens
aactcttttttaaaaattacttttaaa

SEQ ID NO: 3948 - DNA, 27 bp, Homo sapiens
actcttttttaaaaattacttttaaat

SEQ ID NO: 3949 - DNA, 27 bp, Homo sapiens
ctcttttttaaaaattacttttaaata

SEQ ID NO: 3950 - DNA, 27 bp, Homo sapiens
tcttttttaaaaattacttttaaatat

SEQ ID NO: 3951 - DNA, 27 bp, Homo sapiens
cttttttaaaaattacttttaaatatt

SEQ ID NO: 3952 - DNA, 27 bp, Homo sapiens
ttttttaaaaattacttttaaatatta

SEQ ID NO: 3953 - DNA, 27 bp, Homo sapiens
tttttaaaaattacttttaaatattaa

SEQ ID NO: 3954 - DNA, 27 bp, Homo sapiens
ttttaaaaattacttttaaatattaac

SEQ ID NO: 3955 - DNA, 27 bp, Homo sapiens
tttaaaaattacttttaaatattaact

SEQ ID NO: 3956 - DNA, 27 bp, Homo sapiens
attacttttaaatattaactcaaaagt

SEQ ID NO: 3957 - DNA, 27 bp, Homo sapiens
ttacttttaaatattaactcaaaagtt

SEQ ID NO: 3958 - DNA, 27 bp, Homo sapiens
acttttaaatattaactcaaaagttga

SEQ ID NO: 3959 - DNA, 27 bp, Homo sapiens
ttttaaatattaactcaaaagttgaga

SEQ ID NO: 3960 - DNA, 27 bp, Homo sapiens
tttaaatattaactcaaaagttgagat

SEQ ID NO: 3961 - DNA, 27 bp, Homo sapiens
ttaaatattaactcaaaagttgagatt

SEQ ID NO: 3962 - DNA, 27 bp, Homo sapiens
taaatattaactcaaaagttgagattt

SEQ ID NO: 3963 - DNA, 27 bp, Homo sapiens
gtggtgtgccaagacattaattttttt

SEQ ID NO: 3964 - DNA, 27 bp, Homo sapiens
gtgccaagacattaattttttttttaa

SEQ ID NO: 3965 - DNA, 27 bp, Homo sapiens
tgccaagacattaattttttttttaaa

SEQ ID NO: 3966 - DNA, 27 bp, Homo sapiens
gacattaattttttttttaaacaatga

SEQ ID NO: 3967 - DNA, 27 bp, Homo sapiens
acattaattttttttttaaacaatgaa

SEQ ID NO: 3968 - DNA, 27 bp, Homo sapiens
attaattttttttttaaacaatgaagt

SEQ ID NO: 3969 - DNA, 27 bp, Homo sapiens
taattttttttttaaacaatgaagtga

SEQ ID NO: 3970 - DNA, 27 bp, Homo sapiens
aattttttttttaaacaatgaagtgaa

SEQ ID NO: 3971 - DNA, 27 bp, Homo sapiens
attttttttttaaacaatgaagtgaaa

SEQ ID NO: 3972 - DNA, 27 bp, Homo sapiens
ttttttttttaaacaatgaagtgaaaa

SEQ ID NO: 3973 - DNA, 27 bp, Homo sapiens
tttttttttaaacaatgaagtgaaaaa

SEQ ID NO: 3974 - DNA, 27 bp, Homo sapiens
tttttttaaacaatgaagtgaaaaagt

SEQ ID NO: 3975 - DNA, 27 bp, Homo sapiens
ttttttaaacaatgaagtgaaaaagtt

SEQ ID NO: 3976 - DNA, 27 bp, Homo sapiens
tttttaaacaatgaagtgaaaaagttt

SEQ ID NO: 3977 - DNA, 27 bp, Homo sapiens
caatgaagtgaaaaagttttacaatct

SEQ ID NO: 3978 - DNA, 27 bp, Homo sapiens
agtgaaaaagttttacaatctctaggt

SEQ ID NO: 3979 - DNA, 27 bp, Homo sapiens
gtgaaaaagttttacaatctctaggtt

SEQ ID NO: 3980 - DNA, 27 bp, Homo sapiens
tgaaaaagttttacaatctctaggttt

SEQ ID NO: 3981 - DNA, 27 bp, Homo sapiens
acactggttaaattaacattgcataaa

SEQ ID NO: 3982 - DNA, 27 bp, Homo sapiens
cactggttaaattaacattgcataaac

SEQ ID NO: 3983 - DNA, 27 bp, Homo sapiens
actggttaaattaacattgcataaaca

SEQ ID NO: 3984 - DNA, 27 bp, Homo sapiens
taacattgcataaacacttttcaagtc

SEQ ID NO: 3985 - DNA, 27 bp, Homo sapiens
tttcaagtctgatccatatttaataat

SEQ ID NO: 3986 - DNA, 27 bp, Homo sapiens
gatccatatttaataatgctttaaaat

SEQ ID NO: 3987 - DNA, 27 bp, Homo sapiens
atccatatttaataatgctttaaaata

SEQ ID NO: 3988 - DNA, 27 bp, Homo sapiens
tccatatttaataatgctttaaaataa

SEQ ID NO: 3989 - DNA, 27 bp, Homo sapiens
ccatatttaataatgctttaaaataaa

SEQ ID NO: 3990 - DNA, 27 bp, Homo sapiens
catatttaataatgctttaaaataaaa

SEQ ID NO: 3991 - DNA, 27 bp, Homo sapiens
atatttaataatgctttaaaataaaaa

SEQ ID NO: 3992 - DNA, 27 bp, Homo sapiens
atttaataatgctttaaaataaaaata

SEQ ID NO: 3993 - DNA, 27 bp, Homo sapiens
tttaataatgctttaaaataaaaataa

SEQ ID NO: 3994 - DNA, 27 bp, Homo sapiens
ttaataatgctttaaaataaaaataaa

SEQ ID NO: 3995 - DNA, 27 bp, Homo sapiens
taataatgctttaaaataaaaataaaa

SEQ ID NO: 3996 - DNA, 27 bp, Homo sapiens
gctttaaaataaaaataaaaacaatcc

SEQ ID NO: 3997 - DNA, 27 bp, Homo sapiens
aaataaaaataaaaacaatccttttga

SEQ ID NO: 3998 - DNA, 27 bp, Homo sapiens
aataaaaataaaaacaatccttttgat

SEQ ID NO: 3999 - DNA, 27 bp, Homo sapiens
ataaaaataaaaacaatccttttgata

SEQ ID NO: 4000 - DNA, 27 bp, Homo sapiens
taaaaataaaaacaatccttttgataa

SEQ ID NO: 4001 - DNA, 27 bp, Homo sapiens
aaaaataaaaacaatccttttgataaa

SEQ ID NO: 4002 - DNA, 27 bp, Homo sapiens
aaaataaaaacaatccttttgataaat

SEQ ID NO: 4003 - DNA, 27 bp, Homo sapiens
aaataaaaacaatccttttgataaatt

SEQ ID NO: 4004 - DNA, 27 bp, Homo sapiens
aataaaaacaatccttttgataaattt

SEQ ID NO: 4005 - DNA, 27 bp, Homo sapiens
aaaacaatccttttgataaatttaaaa

SEQ ID NO: 4006 - DNA, 27 bp, Homo sapiens
aatccttttgataaatttaaaatgtta

SEQ ID NO: 4007 - DNA, 27 bp, Homo sapiens
atccttttgataaatttaaaatgttac

SEQ ID NO: 4008 - DNA, 27 bp, Homo sapiens
tccttttgataaatttaaaatgttact

SEQ ID NO: 4009 - DNA, 27 bp, Homo sapiens
tttgataaatttaaaatgttacttatt

SEQ ID NO: 4010 - DNA, 27 bp, Homo sapiens
ttgataaatttaaaatgttacttattt

SEQ ID NO: 4011 - DNA, 27 bp, Homo sapiens
tgataaatttaaaatgttacttatttt

SEQ ID NO: 4012 - DNA, 27 bp, Homo sapiens
gataaatttaaaatgttacttatttta

SEQ ID NO: 4013 - DNA, 27 bp, Homo sapiens
ataaatttaaaatgttacttattttaa

SEQ ID NO: 4014 - DNA, 27 bp, Homo sapiens
taaatttaaaatgttacttattttaaa

SEQ ID NO: 4015 - DNA, 27 bp, Homo sapiens
aatttaaaatgttacttattttaaaat

SEQ ID NO: 4016 - DNA, 27 bp, Homo sapiens
atttaaaatgttacttattttaaaata

SEQ ID NO: 4017 - DNA, 27 bp, Homo sapiens
tttaaaatgttacttattttaaaataa

SEQ ID NO: 4018 - DNA, 27 bp, Homo sapiens
ttaaaatgttacttattttaaaataaa

SEQ ID NO: 4019 - DNA, 27 bp, Homo sapiens
taaaatgttacttattttaaaataaat

SEQ ID NO: 4020 - DNA, 27 bp, Homo sapiens
aaatgttacttattttaaaataaatga

SEQ ID NO: 4021 - DNA, 27 bp, Homo sapiens
ttacttattttaaaataaatgaagtga

SEQ ID NO: 4022 - DNA, 27 bp, Homo sapiens
acttattttaaaataaatgaagtgaga

SEQ ID NO: 4023 - DNA, 27 bp, Homo sapiens
cttattttaaaataaatgaagtgagat

SEQ ID NO: 4024 - DNA, 27 bp, Homo sapiens
attttaaaataaatgaagtgagatggc

SEQ ID NO: 4025 - DNA, 27 bp, Homo sapiens
ttttaaaataaatgaagtgagatggca

SEQ ID NO: 4026 - DNA, 27 bp, Homo sapiens
tatccatttcttcatgttaaaagaagt

SEQ ID NO: 4027 - DNA, 27 bp, Homo sapiens
atccatttcttcatgttaaaagaagtc

SEQ ID NO: 4028 - DNA, 27 bp, Homo sapiens
atctcaaactcttagtttttttttttt

SEQ ID NO: 4029 - DNA, 27 bp, Homo sapiens
cttagttttttttttttacaactatgt

SEQ ID NO: 4030 - DNA, 27 bp, Homo sapiens
ttagttttttttttttacaactatgta

SEQ ID NO: 4031 - DNA, 27 bp, Homo sapiens
tagttttttttttttacaactatgtaa

SEQ ID NO: 4032 - DNA, 27 bp, Homo sapiens
agttttttttttttacaactatgtaat

SEQ ID NO: 4033 - DNA, 27 bp, Homo sapiens
gttttttttttttacaactatgtaatt

SEQ ID NO: 4034 - DNA, 27 bp, Homo sapiens
ttttttttttttacaactatgtaattt

SEQ ID NO: 4035 - DNA, 27 bp, Homo sapiens
tttttttttttacaactatgtaattta

SEQ ID NO: 4036 - DNA, 27 bp, Homo sapiens
ttttttttttacaactatgtaatttat

SEQ ID NO: 4037 - DNA, 27 bp, Homo sapiens
tttttttttacaactatgtaatttata

SEQ ID NO: 4038 - DNA, 27 bp, Homo sapiens
ttttttttacaactatgtaatttatat

SEQ ID NO: 4039 - DNA, 27 bp, Homo sapiens
tttttttacaactatgtaatttatatt

SEQ ID NO: 4040 - DNA, 27 bp, Homo sapiens
acaactatgtaatttatattccattta

SEQ ID NO: 4041 - DNA, 27 bp, Homo sapiens
caactatgtaatttatattccatttac

SEQ ID NO: 4042 - DNA, 27 bp, Homo sapiens
aactatgtaatttatattccatttaca

SEQ ID NO: 4043 - DNA, 27 bp, Homo sapiens
gtaatttatattccatttacataagga

SEQ ID NO: 4044 - DNA, 27 bp, Homo sapiens
taatttatattccatttacataaggat

SEQ ID NO: 4045 - DNA, 27 bp, Homo sapiens
aatttatattccatttacataaggata

SEQ ID NO: 4046 - DNA, 27 bp, Homo sapiens
atttatattccatttacataaggatac

SEQ ID NO: 4047 - DNA, 27 bp, Homo sapiens
tttacataaggatacacttatttgtca

SEQ ID NO: 4048 - DNA, 27 bp, Homo sapiens
cataaggatacacttatttgtcaagct

SEQ ID NO: 4049 - DNA, 27 bp, Homo sapiens
caatctgtaaatttttaacctatgtta

SEQ ID NO: 4050 - DNA, 27 bp, Homo sapiens
aatctgtaaatttttaacctatgttac

SEQ ID NO: 4051 - DNA, 27 bp, Homo sapiens
atctgtaaatttttaacctatgttaca

SEQ ID NO: 4052 - DNA, 27 bp, Homo sapiens
tgtgcaagaggtgaagtttatatttga

SEQ ID NO: 4053 - DNA, 27 bp, Homo sapiens
tgcaagaggtgaagtttatatttgaat

SEQ ID NO: 4054 - DNA, 27 bp, Homo sapiens
gcaagaggtgaagtttatatttgaata

SEQ ID NO: 4055 - DNA, 27 bp, Homo sapiens
aagaggtgaagtttatatttgaatatc

SEQ ID NO: 4056 - DNA, 27 bp, Homo sapiens
agaggtgaagtttatatttgaatatcc

SEQ ID NO: 4057 - DNA, 27 bp, Homo sapiens
tgaagtttatatttgaatatccattct

SEQ ID NO: 4058 - DNA, 27 bp, Homo sapiens
tgacttgatgcagttttaatacttgta

SEQ ID NO: 4059 - DNA, 27 bp, Homo sapiens
acttgatgcagttttaatacttgtaat

SEQ ID NO: 4060 - DNA, 27 bp, Homo sapiens
gggatttgacctaatcactaattttca

SEQ ID NO: 4061 - DNA, 27 bp, Homo sapiens
tgacctaatcactaattttcaggtggt

SEQ ID NO: 4062 - DNA, 27 bp, Homo sapiens
gacagtaggatttttcaaacctggtat

SEQ ID NO: 4063 - DNA, 27 bp, Homo sapiens
ccagtggaaggagaatttaataaagat

SEQ ID NO: 4064 - DNA, 27 bp, Homo sapiens
gtggaaggagaatttaataaagatagt

SEQ ID NO: 4065 - DNA, 27 bp, Homo sapiens
ggaaggagaatttaataaagatagtgc

SEQ ID NO: 4066 - DNA, 27 bp, Homo sapiens
gaaggagaatttaataaagatagtgct

SEQ ID NO: 4067 - DNA, 27 bp, Homo sapiens
gagaatttaataaagatagtgctgaaa

SEQ ID NO: 4068 - DNA, 27 bp, Homo sapiens
attccttaggtaatctataactaggac

SEQ ID NO: 4069 - DNA, 27 bp, Homo sapiens
ttccttaggtaatctataactaggact

SEQ ID NO: 4070 - DNA, 27 bp, Homo sapiens
gtaacagtaatacattccattgtttta

SEQ ID NO: 4071 - DNA, 27 bp, Homo sapiens
aacagtaatacattccattgttttagt

SEQ ID NO: 4072 - DNA, 27 bp, Homo sapiens
acagtaatacattccattgttttagta

SEQ ID NO: 4073 - DNA, 27 bp, Homo sapiens
cagtaatacattccattgttttagtaa

SEQ ID NO: 4074 - DNA, 27 bp, Homo sapiens
ttccattgttttagtaaccagaaatct

SEQ ID NO: 4075 - DNA, 27 bp, Homo sapiens
taaccagaaatcttcatgcaatgaaaa

SEQ ID NO: 4076 - DNA, 27 bp, Homo sapiens
tcttcatgcaatgaaaaatactttaat

SEQ ID NO: 4077 - DNA, 27 bp, Homo sapiens
gcaatgaaaaatactttaattcatgaa

SEQ ID NO: 4078 - DNA, 27 bp, Homo sapiens
aatgaaaaatactttaattcatgaagc

SEQ ID NO: 4079 - DNA, 27 bp, Homo sapiens
atgaaaaatactttaattcatgaagct

SEQ ID NO: 4080 - DNA, 27 bp, Homo sapiens
aattcatgaagcttacttttttttttt

SEQ ID NO: 4081 - DNA, 27 bp, Homo sapiens
tcatgaagcttactttttttttttggt

SEQ ID NO: 4082 - DNA, 27 bp, Homo sapiens
gaagcttactttttttttttggtgtca

SEQ ID NO: 4083 - DNA, 27 bp, Homo sapiens
cttactttttttttttggtgtcagagt

SEQ ID NO: 4084 - DNA, 27 bp, Homo sapiens
ttactttttttttttggtgtcagagtc

SEQ ID NO: 4085 - DNA, 27 bp, Homo sapiens
tcaactaatttttgtatttttaggaga

SEQ ID NO: 4086 - DNA, 27 bp, Homo sapiens
actaatttttgtatttttaggagagac

SEQ ID NO: 4087 - DNA, 27 bp, Homo sapiens
aactcatttattcagcaaatatttatt

SEQ ID NO: 4088 - DNA, 27 bp, Homo sapiens
ctcatttattcagcaaatatttattga

SEQ ID NO: 4089 - DNA, 27 bp, Homo sapiens
catttattcagcaaatatttattgagt

SEQ ID NO: 4090 - DNA, 27 bp, Homo sapiens
cgtattttagttttgcaaagaaggggt

SEQ ID NO: 4091 - DNA, 27 bp, Homo sapiens
agctctataattgttttgctacgattc

SEQ ID NO: 4092 - DNA, 27 bp, Homo sapiens
gctactttatgtaaatcacttcattgt

SEQ ID NO: 4093 - DNA, 27 bp, Homo sapiens
ctactttatgtaaatcacttcattgtt

SEQ ID NO: 4094 - DNA, 27 bp, Homo sapiens
tactttatgtaaatcacttcattgttt

SEQ ID NO: 4095 - DNA, 27 bp, Homo sapiens
actttatgtaaatcacttcattgtttt

SEQ ID NO: 4096 - DNA, 27 bp, Homo sapiens
ctttatgtaaatcacttcattgtttta

SEQ ID NO: 4097 - DNA, 27 bp, Homo sapiens
tttatgtaaatcacttcattgttttaa

SEQ ID NO: 4098 - DNA, 27 bp, Homo sapiens
ttatgtaaatcacttcattgttttaaa

SEQ ID NO: 4099 - DNA, 27 bp, Homo sapiens
tcattgttttaaaggaataaacttgat

SEQ ID NO: 4100 - DNA, 27 bp, Homo sapiens
cattgttttaaaggaataaacttgatt

SEQ ID NO: 4101 - DNA, 27 bp, Homo sapiens
tgttttaaaggaataaacttgattata

SEQ ID NO: 4102 - DNA, 27 bp, Homo sapiens
gttttaaaggaataaacttgattatat

SEQ ID NO: 4103 - DNA, 27 bp, Homo sapiens
ttttaaaggaataaacttgattatatt

SEQ ID NO: 4104 - DNA, 27 bp, Homo sapiens
ttaaaggaataaacttgattatattgt

SEQ ID NO: 4105 - DNA, 27 bp, Homo sapiens
taaaggaataaacttgattatattgtt

SEQ ID NO: 4106 - DNA, 27 bp, Homo sapiens
aaaggaataaacttgattatattgttt

SEQ ID NO: 4107 - DNA, 27 bp, Homo sapiens
aaggaataaacttgattatattgtttt

SEQ ID NO: 4108 - DNA, 27 bp, Homo sapiens
aggaataaacttgattatattgttttt

SEQ ID NO: 4109 - DNA, 27 bp, Homo sapiens
taaacttgattatattgtttttttatt

SEQ ID NO: 4110 - DNA, 27 bp, Homo sapiens
aaacttgattatattgtttttttattt

SEQ ID NO: 4111 - DNA, 27 bp, Homo sapiens
cttgattatattgtttttttatttggc

SEQ ID NO: 4112 - DNA, 27 bp, Homo sapiens
ttatattgtttttttatttggcataac

SEQ ID NO: 4113 - DNA, 27 bp, Homo sapiens
tatattgtttttttatttggcataact

SEQ ID NO: 4114 - DNA, 27 bp, Homo sapiens
ttgtttttttatttggcataactgtga

SEQ ID NO: 4115 - DNA, 27 bp, Homo sapiens
tgtttttttatttggcataactgtgat

SEQ ID NO: 4116 - DNA, 27 bp, Homo sapiens
tggcataactgtgattcttttaggaca

SEQ ID NO: 4117 - DNA, 27 bp, Homo sapiens
taactgtgattcttttaggacaattac

SEQ ID NO: 4118 - DNA, 27 bp, Homo sapiens
aactgtgattcttttaggacaattact

SEQ ID NO: 4119 - DNA, 27 bp, Homo sapiens
aaggtgtatgtcagatattcatattga

SEQ ID NO: 4120 - DNA, 27 bp, Homo sapiens
aggtgtatgtcagatattcatattgac

SEQ ID NO: 4121 - DNA, 27 bp, Homo sapiens
cccaaatgtgtaatattccagttttct

SEQ ID NO: 4122 - DNA, 27 bp, Homo sapiens
tgcataagtaattaaaatatacttaaa

SEQ ID NO: 4123 - DNA, 27 bp, Homo sapiens
gcataagtaattaaaatatacttaaaa

SEQ ID NO: 4124 - DNA, 27 bp, Homo sapiens
cataagtaattaaaatatacttaaaaa

SEQ ID NO: 4125 - DNA, 27 bp, Homo sapiens
ataagtaattaaaatatacttaaaaat

SEQ ID NO: 4126 - DNA, 27 bp, Homo sapiens
taagtaattaaaatatacttaaaaatt

SEQ ID NO: 4127 - DNA, 27 bp, Homo sapiens
aagtaattaaaatatacttaaaaatta

SEQ ID NO: 4128 - DNA, 27 bp, Homo sapiens
agtaattaaaatatacttaaaaattaa

SEQ ID NO: 4129 - DNA, 27 bp, Homo sapiens
gtaattaaaatatacttaaaaattaat

SEQ ID NO: 4130 - DNA, 27 bp, Homo sapiens
taattaaaatatacttaaaaattaata

SEQ ID NO: 4131 - DNA, 27 bp, Homo sapiens
attaaaatatacttaaaaattaatagt

SEQ ID NO: 4132 - DNA, 27 bp, Homo sapiens
ttaaaatatacttaaaaattaatagtt

SEQ ID NO: 4133 - DNA, 27 bp, Homo sapiens
taaaatatacttaaaaattaatagttt

SEQ ID NO: 4134 - DNA, 27 bp, Homo sapiens
aaaatatacttaaaaattaatagtttt

SEQ ID NO: 4135 - DNA, 27 bp, Homo sapiens
tatacttaaaaattaatagttttatct

SEQ ID NO: 4136 - DNA, 27 bp, Homo sapiens
cttaaaaattaatagttttatctgggt

SEQ ID NO: 4137 - DNA, 27 bp, Homo sapiens
ttaaaaattaatagttttatctgggta

SEQ ID NO: 4138 - DNA, 27 bp, Homo sapiens
taaaaattaatagttttatctgggtac

SEQ ID NO: 4139 - DNA, 27 bp, Homo sapiens
ttatctgggtacaaataaacaggtgcc

SEQ ID NO: 4140 - DNA, 27 bp, Homo sapiens
cagacaaggaaacttctatgtaaaaat

SEQ ID NO: 4141 - DNA, 27 bp, Homo sapiens
agacaaggaaacttctatgtaaaaatc

SEQ ID NO: 4142 - DNA, 27 bp, Homo sapiens
gacaaggaaacttctatgtaaaaatca

SEQ ID NO: 4143 - DNA, 27 bp, Homo sapiens
acttctatgtaaaaatcactatgattt

SEQ ID NO: 4144 - DNA, 27 bp, Homo sapiens
cttctatgtaaaaatcactatgatttc

SEQ ID NO: 4145 - DNA, 27 bp, Homo sapiens
ttctatgtaaaaatcactatgatttct

SEQ ID NO: 4146 - DNA, 27 bp, Homo sapiens
atgtaaaaatcactatgatttctgaat

SEQ ID NO: 4147 - DNA, 27 bp, Homo sapiens
tgtaaaaatcactatgatttctgaatt

SEQ ID NO: 4148 - DNA, 27 bp, Homo sapiens
cactatgatttctgaattgctatgtga

SEQ ID NO: 4149 - DNA, 27 bp, Homo sapiens
actatgatttctgaattgctatgtgaa

SEQ ID NO: 4150 - DNA, 27 bp, Homo sapiens
gctatgtgaaactacagatctttggaa

SEQ ID NO: 4151 - DNA, 27 bp, Homo sapiens
ctatgtgaaactacagatctttggaac

SEQ ID NO: 4152 - DNA, 27 bp, Homo sapiens
gtagggtgttaagacttacacagtacc

SEQ ID NO: 4153 - DNA, 27 bp, Homo sapiens
tatttaggcctcttgaatttttgatgt

SEQ ID NO: 4154 - DNA, 27 bp, Homo sapiens
cctcttgaatttttgatgtagatgggc

SEQ ID NO: 4155 - DNA, 27 bp, Homo sapiens
ctcttgaatttttgatgtagatgggca

SEQ ID NO: 4156 - DNA, 27 bp, Homo sapiens
tgtagatgggcatttttttaaggtagt

SEQ ID NO: 4157 - DNA, 27 bp, Homo sapiens
tgggcatttttttaaggtagtggttaa

SEQ ID NO: 4158 - DNA, 27 bp, Homo sapiens
taaggtagtggttaattacctttatgt

SEQ ID NO: 4159 - DNA, 27 bp, Homo sapiens
aggtagtggttaattacctttatgtga

SEQ ID NO: 4160 - DNA, 27 bp, Homo sapiens
ggtagtggttaattacctttatgtgaa

SEQ ID NO: 4161 - DNA, 27 bp, Homo sapiens
gtagtggttaattacctttatgtgaac

SEQ ID NO: 4162 - DNA, 27 bp, Homo sapiens
tagtggttaattacctttatgtgaact

SEQ ID NO: 4163 - DNA, 27 bp, Homo sapiens
ttacctttatgtgaactttgaatggtt

SEQ ID NO: 4164 - DNA, 27 bp, Homo sapiens
tttatgtgaactttgaatggtttaaca

SEQ ID NO: 4165 - DNA, 27 bp, Homo sapiens
tgaactttgaatggtttaacaaaagat

SEQ ID NO: 4166 - DNA, 27 bp, Homo sapiens
ctttgaatggtttaacaaaagatttgt

SEQ ID NO: 4167 - DNA, 27 bp, Homo sapiens
tttgaatggtttaacaaaagatttgtt

SEQ ID NO: 4168 - DNA, 27 bp, Homo sapiens
ttgaatggtttaacaaaagatttgttt

SEQ ID NO: 4169 - DNA, 27 bp, Homo sapiens
tgaatggtttaacaaaagatttgtttt

SEQ ID NO: 4170 - DNA, 27 bp, Homo sapiens
gaatggtttaacaaaagatttgttttt

SEQ ID NO: 4171 - DNA, 27 bp, Homo sapiens
atggtttaacaaaagatttgtttttgt

SEQ ID NO: 4172 - DNA, 27 bp, Homo sapiens
tggtttaacaaaagatttgtttttgta

SEQ ID NO: 4173 - DNA, 27 bp, Homo sapiens
ttaacaaaagatttgtttttgtagaga

SEQ ID NO: 4174 - DNA, 27 bp, Homo sapiens
taacaaaagatttgtttttgtagagat

SEQ ID NO: 4175 - DNA, 27 bp, Homo sapiens
aacaaaagatttgtttttgtagagatt

SEQ ID NO: 4176 - DNA, 27 bp, Homo sapiens
caaaagatttgtttttgtagagatttt

SEQ ID NO: 4177 - DNA, 27 bp, Homo sapiens
aaaagatttgtttttgtagagatttta

SEQ ID NO: 4178 - DNA, 27 bp, Homo sapiens
aaagatttgtttttgtagagattttaa

SEQ ID NO: 4179 - DNA, 27 bp, Homo sapiens
aagatttgtttttgtagagattttaaa

SEQ ID NO: 4180 - DNA, 27 bp, Homo sapiens
tgtttttgtagagattttaaaggggga

SEQ ID NO: 4181 - DNA, 27 bp, Homo sapiens
taaagggggagaattctagaaataaat

SEQ ID NO: 4182 - DNA, 27 bp, Homo sapiens
aagggggagaattctagaaataaatgt

SEQ ID NO: 4183 - DNA, 27 bp, Homo sapiens
agggggagaattctagaaataaatgtt

SEQ ID NO: 4184 - DNA, 27 bp, Homo sapiens
gggggagaattctagaaataaatgtta

SEQ ID NO: 4185 - DNA, 27 bp, Homo sapiens
ggggagaattctagaaataaatgttac

SEQ ID NO: 4186 - DNA, 27 bp, Homo sapiens
gggagaattctagaaataaatgttacc

SEQ ID NO: 4187 - DNA, 27 bp, Homo sapiens
aattctagaaataaatgttacctaatt

SEQ ID NO: 4188 - DNA, 27 bp, Homo sapiens
attctagaaataaatgttacctaatta

SEQ ID NO: 4189 - DNA, 27 bp, Homo sapiens
ttctagaaataaatgttacctaattat

SEQ ID NO: 4190 - DNA, 27 bp, Homo sapiens
tctagaaataaatgttacctaattatt

SEQ ID NO: 4191 - DNA, 27 bp, Homo sapiens
ctagaaataaatgttacctaattatta

SEQ ID NO: 4192 - DNA, 27 bp, Homo sapiens
agaaataaatgttacctaattattaca

SEQ ID NO: 4193 - DNA, 27 bp, Homo sapiens
ttacctaattattacagccttaaagac

SEQ ID NO: 4194 - DNA, 27 bp, Homo sapiens
tacctaattattacagccttaaagaca

SEQ ID NO: 4195 - DNA, 27 bp, Homo sapiens
agccttaaagacaaaaatccttgttga

SEQ ID NO: 4196 - DNA, 27 bp, Homo sapiens
cttaaagacaaaaatccttgttgaagt

SEQ ID NO: 4197 - DNA, 27 bp, Homo sapiens
aatccttgttgaagtttttttaaaaaa

SEQ ID NO: 4198 - DNA, 27 bp, Homo sapiens
atccttgttgaagtttttttaaaaaaa

SEQ ID NO: 4199 - DNA, 27 bp, Homo sapiens
ccttgttgaagtttttttaaaaaaagc

SEQ ID NO: 4200 - DNA, 27 bp, Homo sapiens
cttgttgaagtttttttaaaaaaagct

SEQ ID NO: 4201 - DNA, 27 bp, Homo sapiens
ttgaagtttttttaaaaaaagctaaat

SEQ ID NO: 4202 - DNA, 27 bp, Homo sapiens
tgaagtttttttaaaaaaagctaaatt

SEQ ID NO: 4203 - DNA, 27 bp, Homo sapiens
gaagtttttttaaaaaaagctaaatta

SEQ ID NO: 4204 - DNA, 27 bp, Homo sapiens
aagtttttttaaaaaaagctaaattac

SEQ ID NO: 4205 - DNA, 27 bp, Homo sapiens
agtttttttaaaaaaagctaaattaca

SEQ ID NO: 4206 - DNA, 27 bp, Homo sapiens
tttttaaaaaaagctaaattacataga

SEQ ID NO: 4207 - DNA, 27 bp, Homo sapiens
tttaaaaaaagctaaattacatagact

SEQ ID NO: 4208 - DNA, 27 bp, Homo sapiens
agacttaggcattaacatgtttgtgga

SEQ ID NO: 4209 - DNA, 27 bp, Homo sapiens
gacttaggcattaacatgtttgtggaa

SEQ ID NO: 4210 - DNA, 27 bp, Homo sapiens
atagcagacgtatattgtatcatttga

SEQ ID NO: 4211 - DNA, 27 bp, Homo sapiens
cagacgtatattgtatcatttgagtga

SEQ ID NO: 4212 - DNA, 27 bp, Homo sapiens
gacgtatattgtatcatttgagtgaat

SEQ ID NO: 4213 - DNA, 27 bp, Homo sapiens
gtatattgtatcatttgagtgaatgtt

SEQ ID NO: 4214 - DNA, 27 bp, Homo sapiens
tatattgtatcatttgagtgaatgttc

SEQ ID NO: 4215 - DNA, 27 bp, Homo sapiens
atattgtatcatttgagtgaatgttcc

SEQ ID NO: 4216 - DNA, 27 bp, Homo sapiens
gcataggaatttagaacctaactttta

SEQ ID NO: 4217 - DNA, 27 bp, Homo sapiens
cataggaatttagaacctaacttttat

SEQ ID NO: 4218 - DNA, 27 bp, Homo sapiens
ggaatttagaacctaacttttataggt

SEQ ID NO: 4219 - DNA, 27 bp, Homo sapiens
gaatttagaacctaacttttataggtt

SEQ ID NO: 4220 - DNA, 27 bp, Homo sapiens
aatttagaacctaacttttataggtta

SEQ ID NO: 4221 - DNA, 27 bp, Homo sapiens
atttagaacctaacttttataggttat

SEQ ID NO: 4222 - DNA, 27 bp, Homo sapiens
acttttataggttatcaaaactgttgt

SEQ ID NO: 4223 - DNA, 27 bp, Homo sapiens
ttttataggttatcaaaactgttgtca

SEQ ID NO: 4224 - DNA, 27 bp, Homo sapiens
acaattttgtcctaatatatacataga

SEQ ID NO: 4225 - DNA, 27 bp, Homo sapiens
caattttgtcctaatatatacatagaa

SEQ ID NO: 4226 - DNA, 27 bp, Homo sapiens
aattttgtcctaatatatacatagaaa

SEQ ID NO: 4227 - DNA, 27 bp, Homo sapiens
gtcctaatatatacatagaaactttgt

SEQ ID NO: 4228 - DNA, 27 bp, Homo sapiens
aatatatacatagaaactttgtggggc

SEQ ID NO: 4229 - DNA, 27 bp, Homo sapiens
tgcacaagttcatctcatttgtattcc

SEQ ID NO: 4230 - DNA, 27 bp, Homo sapiens
atctcatttgtattccattgatttttt

SEQ ID NO: 4231 - DNA, 27 bp, Homo sapiens
tctcatttgtattccattgattttttt

SEQ ID NO: 4232 - DNA, 27 bp, Homo sapiens
ctcatttgtattccattgatttttttt

SEQ ID NO: 4233 - DNA, 27 bp, Homo sapiens
tcatttgtattccattgattttttttt

SEQ ID NO: 4234 - DNA, 27 bp, Homo sapiens
catttgtattccattgatttttttttt

SEQ ID NO: 4235 - DNA, 27 bp, Homo sapiens
atttgtattccattgattttttttttc

SEQ ID NO: 4236 - DNA, 27 bp, Homo sapiens
tttgtattccattgattttttttttct

SEQ ID NO: 4237 - DNA, 27 bp, Homo sapiens
tccattgattttttttttcttctaaac

SEQ ID NO: 4238 - DNA, 27 bp, Homo sapiens
ccattgattttttttttcttctaaaca

SEQ ID NO: 4239 - DNA, 27 bp, Homo sapiens
tgattttttttttcttctaaacatttt

SEQ ID NO: 4240 - DNA, 27 bp, Homo sapiens
gattttttttttcttctaaacattttt

SEQ ID NO: 4241 - DNA, 27 bp, Homo sapiens
attttttttttcttctaaacatttttt

SEQ ID NO: 4242 - DNA, 27 bp, Homo sapiens
ttttttttttcttctaaacattttttc

SEQ ID NO: 4243 - DNA, 27 bp, Homo sapiens
tttttttttcttctaaacattttttct

SEQ ID NO: 4244 - DNA, 27 bp, Homo sapiens
taaacattttttcttcaaacagtatat

SEQ ID NO: 4245 - DNA, 27 bp, Homo sapiens
aaacattttttcttcaaacagtatata

SEQ ID NO: 4246 - DNA, 27 bp, Homo sapiens
aacattttttcttcaaacagtatataa

SEQ ID NO: 4247 - DNA, 27 bp, Homo sapiens
acattttttcttcaaacagtatataac

SEQ ID NO: 4248 - DNA, 27 bp, Homo sapiens
cattttttcttcaaacagtatataact

SEQ ID NO: 4249 - DNA, 27 bp, Homo sapiens
tcttcaaacagtatataacttttttta

SEQ ID NO: 4250 - DNA, 27 bp, Homo sapiens
aaacagtatataactttttttagggga

SEQ ID NO: 4251 - DNA, 27 bp, Homo sapiens
aacagtatataactttttttaggggat

SEQ ID NO: 4252 - DNA, 27 bp, Homo sapiens
acagtatataactttttttaggggatt

SEQ ID NO: 4253 - DNA, 27 bp, Homo sapiens
cagtatataactttttttaggggattt

SEQ ID NO: 4254 - DNA, 27 bp, Homo sapiens
ataactttttttaggggattttttttt

SEQ ID NO: 4255 - DNA, 27 bp, Homo sapiens
taactttttttaggggattttttttta

SEQ ID NO: 4256 - DNA, 27 bp, Homo sapiens
aggggatttttttttagacagcaaaaa

SEQ ID NO: 4257 - DNA, 27 bp, Homo sapiens
ggggatttttttttagacagcaaaaac

SEQ ID NO: 4258 - DNA, 27 bp, Homo sapiens
gggatttttttttagacagcaaaaact

SEQ ID NO: 4259 - DNA, 27 bp, Homo sapiens
tctgaagatttccatttgtcaaaaagt

SEQ ID NO: 4260 - DNA, 27 bp, Homo sapiens
ctgaagatttccatttgtcaaaaagta

SEQ ID NO: 4261 - DNA, 27 bp, Homo sapiens
tgaagatttccatttgtcaaaaagtaa

SEQ ID NO: 4262 - DNA, 27 bp, Homo sapiens
gaagatttccatttgtcaaaaagtaat

SEQ ID NO: 4263 - DNA, 27 bp, Homo sapiens
tttccatttgtcaaaaagtaatgattt

SEQ ID NO: 4264 - DNA, 27 bp, Homo sapiens
ttccatttgtcaaaaagtaatgatttc

SEQ ID NO: 4265 - DNA, 27 bp, Homo sapiens
tccatttgtcaaaaagtaatgatttct

SEQ ID NO: 4266 - DNA, 27 bp, Homo sapiens
ttgtcaaaaagtaatgatttcttgata

SEQ ID NO: 4267 - DNA, 27 bp, Homo sapiens
tgtcaaaaagtaatgatttcttgataa

SEQ ID NO: 4268 - DNA, 27 bp, Homo sapiens
gtcaaaaagtaatgatttcttgataat

SEQ ID NO: 4269 - DNA, 27 bp, Homo sapiens
tcaaaaagtaatgatttcttgataatt

SEQ ID NO: 4270 - DNA, 27 bp, Homo sapiens
aaaaagtaatgatttcttgataattgt

SEQ ID NO: 4271 - DNA, 27 bp, Homo sapiens
aaagtaatgatttcttgataattgtgt

SEQ ID NO: 4272 - DNA, 27 bp, Homo sapiens
aagtaatgatttcttgataattgtgta

SEQ ID NO: 4273 - DNA, 27 bp, Homo sapiens
gtaatgatttcttgataattgtgtagt

SEQ ID NO: 4274 - DNA, 27 bp, Homo sapiens
taatgatttcttgataattgtgtagta

SEQ ID NO: 4275 - DNA, 27 bp, Homo sapiens
atttcttgataattgtgtagtaatgtt

SEQ ID NO: 4276 - DNA, 27 bp, Homo sapiens
tttcttgataattgtgtagtaatgttt

SEQ ID NO: 4277 - DNA, 27 bp, Homo sapiens
ttcttgataattgtgtagtaatgtttt

SEQ ID NO: 4278 - DNA, 27 bp, Homo sapiens
cttgataattgtgtagtaatgtttttt

SEQ ID NO: 4279 - DNA, 27 bp, Homo sapiens
gataattgtgtagtaatgttttttaga

SEQ ID NO: 4280 - DNA, 27 bp, Homo sapiens
taattgtgtagtaatgttttttagaac

SEQ ID NO: 4281 - DNA, 27 bp, Homo sapiens
aattgtgtagtaatgttttttagaacc

SEQ ID NO: 4282 - DNA, 27 bp, Homo sapiens
taccttaaagctgaatttatatttagt

SEQ ID NO: 4283 - DNA, 27 bp, Homo sapiens
ccttaaagctgaatttatatttagtaa

SEQ ID NO: 4284 - DNA, 27 bp, Homo sapiens
tgaatttatatttagtaacttctgtgt

SEQ ID NO: 4285 - DNA, 27 bp, Homo sapiens
gaatttatatttagtaacttctgtgtt

SEQ ID NO: 4286 - DNA, 27 bp, Homo sapiens
aatttatatttagtaacttctgtgtta

SEQ ID NO: 4287 - DNA, 27 bp, Homo sapiens
atatttagtaacttctgtgttaatact

SEQ ID NO: 4288 - DNA, 27 bp, Homo sapiens
aaactgaatagctgtcataaaatgaaa

SEQ ID NO: 4289 - DNA, 27 bp, Homo sapiens
aactgaatagctgtcataaaatgaaac

SEQ ID NO: 4290 - DNA, 27 bp, Homo sapiens
cataaaatgaaactttctttctaaaga

SEQ ID NO: 4291 - DNA, 27 bp, Homo sapiens
ataaaatgaaactttctttctaaagaa

SEQ ID NO: 4292 - DNA, 27 bp, Homo sapiens
taaaatgaaactttctttctaaagaaa

SEQ ID NO: 4293 - DNA, 27 bp, Homo sapiens
aaatgaaactttctttctaaagaaaga

SEQ ID NO: 4294 - DNA, 27 bp, Homo sapiens
gaaactttctttctaaagaaagatact

SEQ ID NO: 4295 - DNA, 27 bp, Homo sapiens
ctcacatgagttcttgaagaatagtca

SEQ ID NO: 4296 - DNA, 27 bp, Homo sapiens
gttcttgaagaatagtcataactagat

SEQ ID NO: 4297 - DNA, 27 bp, Homo sapiens
ttcttgaagaatagtcataactagatt

SEQ ID NO: 4298 - DNA, 27 bp, Homo sapiens
tcttgaagaatagtcataactagatta

SEQ ID NO: 4299 - DNA, 27 bp, Homo sapiens
tgaagaatagtcataactagattaaga

SEQ ID NO: 4300 - DNA, 27 bp, Homo sapiens
gaagaatagtcataactagattaagat

SEQ ID NO: 4301 - DNA, 27 bp, Homo sapiens
aagaatagtcataactagattaagatc

SEQ ID NO: 4302 - DNA, 27 bp, Homo sapiens
agaatagtcataactagattaagatct

SEQ ID NO: 4303 - DNA, 27 bp, Homo sapiens
tagtcataactagattaagatctgtgt

SEQ ID NO: 4304 - DNA, 27 bp, Homo sapiens
taactagattaagatctgtgttttagt

SEQ ID NO: 4305 - DNA, 27 bp, Homo sapiens
actagattaagatctgtgttttagttt

SEQ ID NO: 4306 - DNA, 27 bp, Homo sapiens
ctagattaagatctgtgttttagttta

SEQ ID NO: 4307 - DNA, 27 bp, Homo sapiens
agattaagatctgtgttttagtttaat

SEQ ID NO: 4308 - DNA, 27 bp, Homo sapiens
gatctgtgttttagtttaatagtttga

SEQ ID NO: 4309 - DNA, 27 bp, Homo sapiens
atctgtgttttagtttaatagtttgaa

SEQ ID NO: 4310 - DNA, 27 bp, Homo sapiens
ctgtgttttagtttaatagtttgaagt

SEQ ID NO: 4311 - DNA, 27 bp, Homo sapiens
gtgttttagtttaatagtttgaagtgc

SEQ ID NO: 4312 - DNA, 27 bp, Homo sapiens
tgttttagtttaatagtttgaagtgcc

SEQ ID NO: 4313 - DNA, 27 bp, Homo sapiens
ctgtttgggataatgataggtaattta

SEQ ID NO: 4314 - DNA, 27 bp, Homo sapiens
gtttgggataatgataggtaatttaga

SEQ ID NO: 4315 - DNA, 27 bp, Homo sapiens
tgggataatgataggtaatttagatga

SEQ ID NO: 4316 - DNA, 27 bp, Homo sapiens
gggataatgataggtaatttagatgaa

SEQ ID NO: 4317 - DNA, 27 bp, Homo sapiens
ataatgataggtaatttagatgaattt

SEQ ID NO: 4318 - DNA, 27 bp, Homo sapiens
taatgataggtaatttagatgaattta

SEQ ID NO: 4319 - DNA, 27 bp, Homo sapiens
ataggtaatttagatgaatttagggga

SEQ ID NO: 4320 - DNA, 27 bp, Homo sapiens
aggtaatttagatgaatttaggggaaa

SEQ ID NO: 4321 - DNA, 27 bp, Homo sapiens
ttagatgaatttaggggaaaaaaaagt

SEQ ID NO: 4322 - DNA, 27 bp, Homo sapiens
tagatgaatttaggggaaaaaaaagtt

SEQ ID NO: 4323 - DNA, 27 bp, Homo sapiens
aggggaaaaaaaagttatctgcagata

SEQ ID NO: 4324 - DNA, 27 bp, Homo sapiens
ggggaaaaaaaagttatctgcagatat

SEQ ID NO: 4325 - DNA, 27 bp, Homo sapiens
aaaaaaagttatctgcagatatgttga

SEQ ID NO: 4326 - DNA, 27 bp, Homo sapiens
ctgtcttgtgttttcatgttgaaaata

SEQ ID NO: 4327 - DNA, 27 bp, Homo sapiens
tgtcttgtgttttcatgttgaaaatac

SEQ ID NO: 4328 - DNA, 27 bp, Homo sapiens
gtcttgtgttttcatgttgaaaatact

SEQ ID NO: 4329 - DNA, 27 bp, Homo sapiens
ttcatgttgaaaatacttttgcatttt

SEQ ID NO: 4330 - DNA, 27 bp, Homo sapiens
tcatgttgaaaatacttttgcattttt

SEQ ID NO: 4331 - DNA, 27 bp, Homo sapiens
catgttgaaaatacttttgcatttttc

SEQ ID NO: 4332 - DNA, 27 bp, Homo sapiens
atgttgaaaatacttttgcatttttcc

SEQ ID NO: 4333 - DNA, 27 bp, Homo sapiens
tacttttgcatttttcctttgagtgcc

SEQ ID NO: 4334 - DNA, 27 bp, Homo sapiens
tttgagtgccaatttcttactagtact

SEQ ID NO: 4335 - DNA, 27 bp, Homo sapiens
gtgccaatttcttactagtactatttc

SEQ ID NO: 4336 - DNA, 27 bp, Homo sapiens
tgccaatttcttactagtactatttct

SEQ ID NO: 4337 - DNA, 27 bp, Homo sapiens
cttactagtactatttcttaatgtaac

SEQ ID NO: 4338 - DNA, 27 bp, Homo sapiens
ttactagtactatttcttaatgtaaca

SEQ ID NO: 4339 - DNA, 27 bp, Homo sapiens
agtactatttcttaatgtaacatgttt

SEQ ID NO: 4340 - DNA, 27 bp, Homo sapiens
gtactatttcttaatgtaacatgttta

SEQ ID NO: 4341 - DNA, 27 bp, Homo sapiens
tactatttcttaatgtaacatgtttac

SEQ ID NO: 4342 - DNA, 27 bp, Homo sapiens
tcttaatgtaacatgtttacctggaat

SEQ ID NO: 4343 - DNA, 27 bp, Homo sapiens
tacctggaatgtattttaactattttt

SEQ ID NO: 4344 - DNA, 27 bp, Homo sapiens
cctggaatgtattttaactatttttgt

SEQ ID NO: 4345 - DNA, 27 bp, Homo sapiens
ctggaatgtattttaactatttttgta

SEQ ID NO: 4346 - DNA, 27 bp, Homo sapiens
tggaatgtattttaactatttttgtat

SEQ ID NO: 4347 - DNA, 27 bp, Homo sapiens
ggaatgtattttaactatttttgtata

SEQ ID NO: 4348 - DNA, 27 bp, Homo sapiens
aatgtattttaactatttttgtatagt

SEQ ID NO: 4349 - DNA, 27 bp, Homo sapiens
tgtattttaactatttttgtatagtgt

SEQ ID NO: 4350 - DNA, 27 bp, Homo sapiens
gtattttaactatttttgtatagtgta

SEQ ID NO: 4351 - DNA, 27 bp, Homo sapiens
tattttaactatttttgtatagtgtaa

SEQ ID NO: 4352 - DNA, 27 bp, Homo sapiens
actatttttgtatagtgtaaactgaaa

SEQ ID NO: 4353 - DNA, 27 bp, Homo sapiens
ctatttttgtatagtgtaaactgaaac

SEQ ID NO: 4354 - DNA, 27 bp, Homo sapiens
tatttttgtatagtgtaaactgaaaca

SEQ ID NO: 4355 - DNA, 27 bp, Homo sapiens
taaactgaaacatgcacattttgtaca

SEQ ID NO: 4356 - DNA, 27 bp, Homo sapiens
gaaacatgcacattttgtacattgtgc

SEQ ID NO: 4357 - DNA, 27 bp, Homo sapiens
gatccagttgttttccatcatttggtt

SEQ ID NO: 4358 - DNA, 27 bp, Homo sapiens
tccagttgttttccatcatttggttgc

SEQ ID NO: 4359 - DNA, 27 bp, Homo sapiens
gaatgttggtcatatcaaacattaaaa

SEQ ID NO: 4360 - DNA, 27 bp, Homo sapiens
aatgttggtcatatcaaacattaaaaa

SEQ ID NO: 4361 - DNA, 27 bp, Homo sapiens
atgttggtcatatcaaacattaaaaat

SEQ ID NO: 4362 - DNA, 27 bp, Homo sapiens
tggtcatatcaaacattaaaaatgacc

SEQ ID NO: 4363 - DNA, 27 bp, Homo sapiens
taaaaatgaccactcttttaattgaaa

SEQ ID NO: 4364 - DNA, 27 bp, Homo sapiens
aaaaatgaccactcttttaattgaaat

SEQ ID NO: 4365 - DNA, 27 bp, Homo sapiens
cactcttttaattgaaattaactttta

SEQ ID NO: 4366 - DNA, 27 bp, Homo sapiens
actcttttaattgaaattaacttttaa

SEQ ID NO: 4367 - DNA, 27 bp, Homo sapiens
tcttttaattgaaattaacttttaaat

SEQ ID NO: 4368 - DNA, 27 bp, Homo sapiens
ttttaattgaaattaacttttaaatgt

SEQ ID NO: 4369 - DNA, 27 bp, Homo sapiens
tttaattgaaattaacttttaaatgtt

SEQ ID NO: 4370 - DNA, 27 bp, Homo sapiens
ttaattgaaattaacttttaaatgttt

SEQ ID NO: 4371 - DNA, 27 bp, Homo sapiens
taattgaaattaacttttaaatgttta

SEQ ID NO: 4372 - DNA, 27 bp, Homo sapiens
aattgaaattaacttttaaatgtttat

SEQ ID NO: 4373 - DNA, 27 bp, Homo sapiens
attgaaattaacttttaaatgtttata

SEQ ID NO: 4374 - DNA, 27 bp, Homo sapiens
gaaattaacttttaaatgtttatagga

SEQ ID NO: 4375 - DNA, 27 bp, Homo sapiens
ttaacttttaaatgtttataggagtat

SEQ ID NO: 4376 - DNA, 27 bp, Homo sapiens
cttttaaatgtttataggagtatgtgc

SEQ ID NO: 4377 - DNA, 27 bp, Homo sapiens
ttttaaatgtttataggagtatgtgct

SEQ ID NO: 4378 - DNA, 27 bp, Homo sapiens
gtgctgtgaagtgatctaaaatttgta

SEQ ID NO: 4379 - DNA, 27 bp, Homo sapiens
gctgtgaagtgatctaaaatttgtaat

SEQ ID NO: 4380 - DNA, 27 bp, Homo sapiens
ctgtgaagtgatctaaaatttgtaata

SEQ ID NO: 4381 - DNA, 27 bp, Homo sapiens
tgtgaagtgatctaaaatttgtaatat

SEQ ID NO: 4382 - DNA, 27 bp, Homo sapiens
gtgaagtgatctaaaatttgtaatatt

SEQ ID NO: 4383 - DNA, 27 bp, Homo sapiens
tgaagtgatctaaaatttgtaatattt

SEQ ID NO: 4384 - DNA, 27 bp, Homo sapiens
gaagtgatctaaaatttgtaatatttt

SEQ ID NO: 4385 - DNA, 27 bp, Homo sapiens
tgatctaaaatttgtaatatttttgtc

SEQ ID NO: 4386 - DNA, 27 bp, Homo sapiens
gatctaaaatttgtaatatttttgtca

SEQ ID NO: 4387 - DNA, 27 bp, Homo sapiens
taaaatttgtaatatttttgtcatgaa

SEQ ID NO: 4388 - DNA, 27 bp, Homo sapiens
aaaatttgtaatatttttgtcatgaac

SEQ ID NO: 4389 - DNA, 27 bp, Homo sapiens
aaatttgtaatatttttgtcatgaact

SEQ ID NO: 4390 - DNA, 27 bp, Homo sapiens
ttgtaatatttttgtcatgaactgtac

SEQ ID NO: 4391 - DNA, 27 bp, Homo sapiens
tgtaatatttttgtcatgaactgtact

SEQ ID NO: 4392 - DNA, 27 bp, Homo sapiens
tgaactgtactactcctaattattgta

SEQ ID NO: 4393 - DNA, 27 bp, Homo sapiens
gaactgtactactcctaattattgtaa

SEQ ID NO: 4394 - DNA, 27 bp, Homo sapiens
actcctaattattgtaatgtaataaaa

SEQ ID NO: 4395 - DNA, 27 bp, Homo sapiens
ctcctaattattgtaatgtaataaaaa

SEQ ID NO: 4396 - DNA, 27 bp, Homo sapiens
cctaattattgtaatgtaataaaaata

SEQ ID NO: 4397 - DNA, 27 bp, Homo sapiens
taattattgtaatgtaataaaaatagt

SEQ ID NO: 4398 - DNA, 27 bp, Homo sapiens
aattattgtaatgtaataaaaatagtt

SEQ ID NO: 4399 - DNA, 27 bp, Homo sapiens
ttattgtaatgtaataaaaatagttac

SEQ ID NO: 4400 - DNA, 27 bp, Homo sapiens
tattgtaatgtaataaaaatagttaca

SEQ ID NO: 4401 - DNA, 27 bp, Homo sapiens
gtaatgtaataaaaatagttacagtga

SEQ ID NO: 4402 - DNA, 27 bp, Homo sapiens
taatgtaataaaaatagttacagtgac

SEQ ID NO: 4403 - DNA, 27 bp, Homo sapiens
aatgtaataaaaatagttacagtgaca

SEQ ID NO: 4404 - DNA, 27 bp, Homo sapiens
aaaaatagttacagtgacaaaaaaaaa

SEQ ID NO: 4405 - DNA, 27 bp, Homo sapiens
aaaatagttacagtgacaaaaaaaaaa

SEQ ID NO: 4406 - DNA, 27 bp, Homo sapiens
aatagttacagtgacaaaaaaaaaaaa

SEQ ID NO: 4407 - RNA, 27 nt, Artificial Sequence
  Description of Artificial Sequence: Synthetic oligonucleotide
uauucagucauuuucagcaggccucuc

SEQ ID NO: 4408 - RNA, 27 nt, Artificial Sequence
  Description of Artificial Sequence: Synthetic oligonucleotide
auauucagucauuuucagcaggccucu

SEQ ID NO: 4409 - RNA, 27 nt, Artificial Sequence
  Description of Artificial Sequence: Synthetic oligonucleotide
uauauucagucauuuucagcaggccuc

SEQ ID NO: 4410 - RNA, 27 nt, Artificial Sequence
  Description of Artificial Sequence: Synthetic oligonucleotide
uuauauucagucauuuucagcaggccu

SEQ ID NO: 4411 - RNA, 27 nt, Artificial Sequence
  Description of Artificial Sequence: Synthetic oligonucleotide
ucuugccuacgccaccagcuccaacua

SEQ ID NO: 4412 - RNA, 27 nt, Artificial Sequence
  Description of Artificial Sequence: Synthetic oligonucleotide
cucuugccuacgccaccagcuccaacu

SEQ ID NO: 4413 - RNA, 27 nt, Artificial Sequence
  Description of Artificial Sequence: Synthetic oligonucleotide
acucuugccuacgccaccagcuccaac

SEQ ID NO: 4414 - RNA, 27 nt, Artificial Sequence
  Description of Artificial Sequence: Synthetic oligonucleotide
cacucuugccuacgccaccagcuccaa

SEQ ID NO: 4415 - RNA, 27 nt, Artificial Sequence
  Description of Artificial Sequence: Synthetic oligonucleotide
gcacucuugccuacgccaccagcucca

SEQ ID NO: 4416 - RNA, 27 nt, Artificial Sequence
  Description of Artificial Sequence: Synthetic oligonucleotide
ggcacucuugccuacgccaccagcucc

SEQ ID NO: 4417 - RNA, 27 nt, Artificial Sequence
  Description of Artificial Sequence: Synthetic oligonucleotide
aggcacucuugccuacgccaccagcuc

SEQ ID NO: 4418 - RNA, 27 nt, Artificial Sequence
  Description of Artificial Sequence: Synthetic oligonucleotide
acaaaaugauucugaauuagcuguauc

SEQ ID NO: 4419 - RNA, 27 nt, Artificial Sequence
  Description of Artificial Sequence: Synthetic oligonucleotide
aagagacagguuucuccaucaauuacu

SEQ ID NO: 4420 - RNA, 27 nt, Artificial Sequence
  Description of Artificial Sequence: Synthetic oligonucleotide
caagagacagguuucuccaucaauuac

SEQ ID NO: 4421 - RNA, 27 nt, Artificial Sequence
  Description of Artificial Sequence: Synthetic oligonucleotide
uauccaagagacagguuucuccaucaa

SEQ ID NO: 4422 - RNA, 27 nt, Artificial Sequence
  Description of Artificial Sequence: Synthetic oligonucleotide
gugucgagaauauccaagagacagguu

SEQ ID NO: 4423 - RNA, 27 nt, Artificial Sequence
  Description of Artificial Sequence: Synthetic oligonucleotide
cugugucgagaauauccaagagacagg

SEQ ID NO: 4424 - RNA, 27 nt, Artificial Sequence
  Description of Artificial Sequence: Synthetic oligonucleotide
gcugugucgagaauauccaagagacag

SEQ ID NO: 4425 - RNA, 27 nt, Artificial Sequence
  Description of Artificial Sequence: Synthetic oligonucleotide
ugcugugucgagaauauccaagagaca

SEQ ID NO: 4426 - RNA, 27 nt, Artificial Sequence
  Description of Artificial Sequence: Synthetic oligonucleotide
cugcugugucgagaauauccaagagac

SEQ ID NO: 4427 - RNA, 27 nt, Artificial Sequence
  Description of Artificial Sequence: Synthetic oligonucleotide
ccugcugugucgagaauauccaagaga

SEQ ID NO: 4428 - RNA, 27 nt, Artificial Sequence
  Description of Artificial Sequence: Synthetic oligonucleotide
accugcugugucgagaauauccaagag

SEQ ID NO: 4429 - RNA, 27 nt, Artificial Sequence
  Description of Artificial Sequence: Synthetic oligonucleotide
gaccugcugugucgagaauauccaaga

SEQ ID NO: 4430 - RNA, 27 nt, Artificial Sequence
  Description of Artificial Sequence: Synthetic oligonucleotide
gcacuguacuccucuugaccugcugug

SEQ ID NO: 4431 - RNA, 27 nt, Artificial Sequence
  Description of Artificial Sequence: Synthetic oligonucleotide
ugcacuguacuccucuugaccugcugu

SEQ ID NO: 4432 - RNA, 27 nt, Artificial Sequence
  Description of Artificial Sequence: Synthetic oligonucleotide
uugcacuguacuccucuugaccugcug

SEQ ID NO: 4433 - RNA, 27 nt, Artificial Sequence
  Description of Artificial Sequence: Synthetic oligonucleotide
uggucccucauugcacuguacuccucu

SEQ ID NO: 4434 - RNA, 27 nt, Artificial Sequence
  Description of Artificial Sequence: Synthetic oligonucleotide
cuggucccucauugcacuguacuccuc

SEQ ID NO: 4435 - RNA, 27 nt, Artificial Sequence
  Description of Artificial Sequence: Synthetic oligonucleotide
acuggucccucauugcacuguacuccu

SEQ ID NO: 4436 - RNA, 27 nt, Artificial Sequence
  Description of Artificial Sequence: Synthetic oligonucleotide
uacuggucccucauugcacuguacucc

SEQ ID NO: 4437 - RNA, 27 nt, Artificial Sequence
  Description of Artificial Sequence: Synthetic oligonucleotide
guacuggucccucauugcacuguacuc

SEQ ID NO: 4438 - RNA, 27 nt, Artificial Sequence
  Description of Artificial Sequence: Synthetic oligonucleotide
uguacuggucccucauugcacuguacu

SEQ ID NO: 4439 - RNA, 27 nt, Artificial Sequence
  Description of Artificial Sequence: Synthetic oligonucleotide
auguacuggucccucauugcacuguac

SEQ ID NO: 4440 - RNA, 27 nt, Artificial Sequence
  Description of Artificial Sequence: Synthetic oligonucleotide
cauguacuggucccucauugcacugua

SEQ ID NO: 4441 - RNA, 27 nt, Artificial Sequence
  Description of Artificial Sequence: Synthetic oligonucleotide
ucauguacuggucccucauugcacugu

SEQ ID NO: 4442 - RNA, 27 nt, Artificial Sequence
  Description of Artificial Sequence: Synthetic oligonucleotide
auuuaguauuauuuauggcaaauacac

SEQ ID NO: 4443 - RNA, 27 nt, Artificial Sequence
  Description of Artificial Sequence: Synthetic oligonucleotide
gauuuaguauuauuuauggcaaauaca

SEQ ID NO: 4444 - RNA, 27 nt, Artificial Sequence
  Description of Artificial Sequence: Synthetic oligonucleotide
ugauuuaguauuauuuauggcaaauac

SEQ ID NO: 4445 - RNA, 27 nt, Artificial Sequence
  Description of Artificial Sequence: Synthetic oligonucleotide
augauuuaguauuauuuauggcaaaua

SEQ ID NO: 4446 - RNA, 27 nt, Artificial Sequence
  Description of Artificial Sequence: Synthetic oligonucleotide
aaugauuuaguauuauuuauggcaaau

SEQ ID NO: 4447 - RNA, 27 nt, Artificial Sequence
  Description of Artificial Sequence: Synthetic oligonucleotide
aaaugauuuaguauuauuuauggcaaa

SEQ ID NO: 4448 - RNA, 27 nt, Artificial Sequence
  Description of Artificial Sequence: Synthetic oligonucleotide
caaaugauuuaguauuauuuauggcaa

SEQ ID NO: 4449 - RNA, 27 nt, Artificial Sequence
  Description of Artificial Sequence: Synthetic oligonucleotide
ugaauaucuucaaaugauuuaguauua

SEQ ID NO: 4450 - RNA, 27 nt, Artificial Sequence
  Description of Artificial Sequence: Synthetic oligonucleotide
gugaauaucuucaaaugauuuaguauu

SEQ ID NO: 4451 - RNA, 27 nt, Artificial Sequence
  Description of Artificial Sequence: Synthetic oligonucleotide
ggugaauaucuucaaaugauuuaguau

SEQ ID NO: 4452 - RNA, 27 nt, Artificial Sequence
  Description of Artificial Sequence: Synthetic oligonucleotide
uggugaauaucuucaaaugauuuagua

SEQ ID NO: 4453 - RNA, 27 nt, Artificial Sequence
  Description of Artificial Sequence: Synthetic oligonucleotide
auggugaauaucuucaaaugauuuagu

SEQ ID NO: 4454 - RNA, 27 nt, Artificial Sequence
  Description of Artificial Sequence: Synthetic oligonucleotide
aauggugaauaucuucaaaugauuuag

SEQ ID NO: 4455 - RNA, 27 nt, Artificial Sequence
  Description of Artificial Sequence: Synthetic oligonucleotide
uaauggugaauaucuucaaaugauuua

SEQ ID NO: 4456 - RNA, 27 nt, Artificial Sequence
  Description of Artificial Sequence: Synthetic oligonucleotide
auaauggugaauaucuucaaaugauuu

SEQ ID NO: 4457 - RNA, 27 nt, Artificial Sequence
  Description of Artificial Sequence: Synthetic oligonucleotide
uauaauggugaauaucuucaaaugauu

SEQ ID NO: 4458 - RNA, 27 nt, Artificial Sequence
  Description of Artificial Sequence: Synthetic oligonucleotide
auuuguucucuauaauggugaauaucu

SEQ ID NO: 4459 - RNA, 27 nt, Artificial Sequence
  Description of Artificial Sequence: Synthetic oligonucleotide
aauuuguucucuauaauggugaauauc

SEQ ID NO: 4460 - RNA, 27 nt, Artificial Sequence
  Description of Artificial Sequence: Synthetic oligonucleotide
uaauuuguucucuauaauggugaauau

SEQ ID NO: 4461 - RNA, 27 nt, Artificial Sequence
  Description of Artificial Sequence: Synthetic oligonucleotide
uuaauuuguucucuauaauggugaaua

SEQ ID NO: 4462 - RNA, 27 nt, Artificial Sequence
  Description of Artificial Sequence: Synthetic oligonucleotide
uuuaauuuguucucuauaauggugaau

SEQ ID NO: 4463 - RNA, 27 nt, Artificial Sequence
  Description of Artificial Sequence: Synthetic oligonucleotide
uuuuaauuuguucucuauaauggugaa

SEQ ID NO: 4464 - RNA, 27 nt, Artificial Sequence
  Description of Artificial Sequence: Synthetic oligonucleotide
cuuuuaauuuguucucuauaaugguga

SEQ ID NO: 4465 - RNA, 27 nt, Artificial Sequence
  Description of Artificial Sequence: Synthetic oligonucleotide
ucuuuuaauuuguucucuauaauggug

SEQ ID NO: 4466 - RNA, 27 nt, Artificial Sequence
  Description of Artificial Sequence: Synthetic oligonucleotide
cucuuuuaauuuguucucuauaauggu

SEQ ID NO: 4467 - RNA, 27 nt, Artificial Sequence
  Description of Artificial Sequence: Synthetic oligonucleotide
cauuuauuuccuacuaggaccauaggu

SEQ ID NO: 4468 - RNA, 27 nt, Artificial Sequence
  Description of Artificial Sequence: Synthetic oligonucleotide
cuacuguucuagaaggcaaaucacauu

SEQ ID NO: 4469 - RNA, 27 nt, Artificial Sequence
  Description of Artificial Sequence: Synthetic oligonucleotide
ucuacuguucuagaaggcaaaucacau

SEQ ID NO: 4470 - RNA, 27 nt, Artificial Sequence
  Description of Artificial Sequence: Synthetic oligonucleotide
ugucuacuguucuagaaggcaaaucac

SEQ ID NO: 4471 - RNA, 27 nt, Artificial Sequence
  Description of Artificial Sequence: Synthetic oligonucleotide
guuucaauaaaaggaauuccauaacuu

SEQ ID NO: 4472 - RNA, 27 nt, Artificial Sequence
  Description of Artificial Sequence: Synthetic oligonucleotide
uguuucaauaaaaggaauuccauaacu

SEQ ID NO: 4473 - RNA, 27 nt, Artificial Sequence
  Description of Artificial Sequence: Synthetic oligonucleotide
auguuucaauaaaaggaauuccauaac

SEQ ID NO: 4474 - RNA, 27 nt, Artificial Sequence
  Description of Artificial Sequence: Synthetic oligonucleotide
cucgaacuaauguauagaaggcaucau

SEQ ID NO: 4475 - RNA, 27 nt, Artificial Sequence
  Description of Artificial Sequence: Synthetic oligonucleotide
ucucgaacuaauguauagaaggcauca

SEQ ID NO: 4476 - RNA, 27 nt, Artificial Sequence
  Description of Artificial Sequence: Synthetic oligonucleotide
uuucuuuauguuuucgaauuucucgaa

SEQ ID NO: 4477 - RNA, 27 nt, Artificial Sequence
  Description of Artificial Sequence: Synthetic oligonucleotide
uugcucaucuuuucuuuauguuuucga

SEQ ID NO: 4478 - RNA, 27 nt, Artificial Sequence
  Description of Artificial Sequence: Synthetic oligonucleotide
uuugcucaucuuuucuuuauguuuucg

SEQ ID NO: 4479 - RNA, 27 nt, Artificial Sequence
  Description of Artificial Sequence: Synthetic oligonucleotide
cuuugcucaucuuuucuuuauguuuuc

SEQ ID NO: 4480 - RNA, 27 nt, Artificial Sequence
  Description of Artificial Sequence: Synthetic oligonucleotide
ucuuugcucaucuuuucuuuauguuuu

SEQ ID NO: 4481 - RNA, 27 nt, Artificial Sequence
  Description of Artificial Sequence: Synthetic oligonucleotide
aucuuugcucaucuuuucuuuauguuu

SEQ ID NO: 4482 - RNA, 27 nt, Artificial Sequence
  Description of Artificial Sequence: Synthetic oligonucleotide
caucuuugcucaucuuuucuuuauguu

SEQ ID NO: 4483 - RNA, 27 nt, Artificial Sequence
  Description of Artificial Sequence: Synthetic oligonucleotide
ccaucuuugcucaucuuuucuuuaugu

SEQ ID NO: 4484 - RNA, 27 nt, Artificial Sequence
  Description of Artificial Sequence: Synthetic oligonucleotide
accaucuuugcucaucuuuucuuuaug

SEQ ID NO: 4485 - RNA, 27 nt, Artificial Sequence
  Description of Artificial Sequence: Synthetic oligonucleotide
uaccaucuuugcucaucuuuucuuuau

SEQ ID NO: 4486 - RNA, 27 nt, Artificial Sequence
  Description of Artificial Sequence: Synthetic oligonucleotide
guguaauguacaaaaauuaccacuugu

SEQ ID NO: 4487 - RNA, 27 nt, Artificial Sequence
  Description of Artificial Sequence: Synthetic oligonucleotide
aguguaauguacaaaaauuaccacuug

SEQ ID NO: 4488 - RNA, 27 nt, Artificial Sequence
  Description of Artificial Sequence: Synthetic oligonucleotide
gcuaauaauuuaguguaauguacaaaa

SEQ ID NO: 4489 - RNA, 27 nt, Artificial Sequence
  Description of Artificial Sequence: Synthetic oligonucleotide
ugcuaauaauuuaguguaauguacaaa

SEQ ID NO: 4490 - RNA, 27 nt, Artificial Sequence
  Description of Artificial Sequence: Synthetic oligonucleotide
augcuaauaauuuaguguaauguacaa

SEQ ID NO: 4491 - RNA, 27 nt, Artificial Sequence
  Description of Artificial Sequence: Synthetic oligonucleotide
aaugcuaauaauuuaguguaauguaca

SEQ ID NO: 4492 - RNA, 27 nt, Artificial Sequence
  Description of Artificial Sequence: Synthetic oligonucleotide
aaaugcuaauaauuuaguguaauguac

SEQ ID NO: 4493 - RNA, 27 nt, Artificial Sequence
  Description of Artificial Sequence: Synthetic oligonucleotide
caaaugcuaauaauuuaguguaaugua

SEQ ID NO: 4494 - RNA, 27 nt, Artificial Sequence
  Description of Artificial Sequence: Synthetic oligonucleotide
acaaaugcuaauaauuuaguguaaugu

SEQ ID NO: 4495 - RNA, 27 nt, Artificial Sequence
  Description of Artificial Sequence: Synthetic oligonucleotide
aacaaaugcuaauaauuuaguguaaug

SEQ ID NO: 4496 - RNA, 27 nt, Artificial Sequence
  Description of Artificial Sequence: Synthetic oligonucleotide
aaacaaaugcuaauaauuuaguguaau

SEQ ID NO: 4497 - RNA, 27 nt, Artificial Sequence
  Description of Artificial Sequence: Synthetic oligonucleotide
gguaaugcuaaaacaaaugcuaauaau

SEQ ID NO: 4498 - RNA, 27 nt, Artificial Sequence
  Description of Artificial Sequence: Synthetic oligonucleotide
agguaaugcuaaaacaaaugcuaauaa

SEQ ID NO: 4499 - RNA, 27 nt, Artificial Sequence
  Description of Artificial Sequence: Synthetic oligonucleotide
uagguaaugcuaaaacaaaugcuaaua

SEQ ID NO: 4500 - RNA, 27 nt, Artificial Sequence
  Description of Artificial Sequence: Synthetic oligonucleotide
uuagguaaugcuaaaacaaaugcuaau

SEQ ID NO: 4501 - RNA, 27 nt, Artificial Sequence
  Description of Artificial Sequence: Synthetic oligonucleotide
auuagguaaugcuaaaacaaaugcuaa

SEQ ID NO: 4502 - RNA, 27 nt, Artificial Sequence
  Description of Artificial Sequence: Synthetic oligonucleotide
aauuagguaaugcuaaaacaaaugcua

SEQ ID NO: 4503 - RNA, 27 nt, Artificial Sequence
  Description of Artificial Sequence: Synthetic oligonucleotide
aaauuagguaaugcuaaaacaaaugcu

SEQ ID NO: 4504 - RNA, 27 nt, Artificial Sequence
  Description of Artificial Sequence: Synthetic oligonucleotide
aaaauuagguaaugcuaaaacaaaugc

SEQ ID NO: 4505 - RNA, 27 nt, Artificial Sequence
  Description of Artificial Sequence: Synthetic oligonucleotide
aaaaauuagguaaugcuaaaacaaaug

SEQ ID NO: 4506 - RNA, 27 nt, Artificial Sequence
  Description of Artificial Sequence: Synthetic oligonucleotide
acuuccacugucauuuuaaaauaagca

SEQ ID NO: 4507 - RNA, 27 nt, Artificial Sequence
  Description of Artificial Sequence: Synthetic oligonucleotide
aaacuuccacugucauuuuaaaauaag

SEQ ID NO: 4508 - RNA, 27 nt, Artificial Sequence
  Description of Artificial Sequence: Synthetic oligonucleotide
aacucugggaauacuggcacuuagagg

SEQ ID NO: 4509 - RNA, 27 nt, Artificial Sequence
  Description of Artificial Sequence: Synthetic oligonucleotide
augauucaaaagcuucauuaauuuguu

SEQ ID NO: 4510 - RNA, 27 nt, Artificial Sequence
  Description of Artificial Sequence: Synthetic oligonucleotide
gaugauucaaaagcuucauuaauuugu

SEQ ID NO: 4511 - RNA, 27 nt, Artificial Sequence
  Description of Artificial Sequence: Synthetic oligonucleotide
cauuuaugugacuagauaaaacacaga

SEQ ID NO: 4512 - RNA, 27 nt, Artificial Sequence
  Description of Artificial Sequence: Synthetic oligonucleotide
ccauuuaugugacuagauaaaacacag

SEQ ID NO: 4513 - RNA, 27 nt, Artificial Sequence
  Description of Artificial Sequence: Synthetic oligonucleotide
aauccauuuaugugacuagauaaaaca

SEQ ID NO: 4514 - RNA, 27 nt, Artificial Sequence
  Description of Artificial Sequence: Synthetic oligonucleotide
cugaaauuaguaauuaauccauuuaug

SEQ ID NO: 4515 - RNA, 27 nt, Artificial Sequence
  Description of Artificial Sequence: Synthetic oligonucleotide
acugaaauuaguaauuaauccauuuau

SEQ ID NO: 4516 - RNA, 27 nt, Artificial Sequence
  Description of Artificial Sequence: Synthetic oligonucleotide
ccucaauguuucaguaaaaaccaauua

SEQ ID NO: 4517 - RNA, 27 nt, Artificial Sequence
  Description of Artificial Sequence: Synthetic oligonucleotide
auuuaucuaaugugaaaaggaaauggc

SEQ ID NO: 4518 - RNA, 27 nt, Artificial Sequence
  Description of Artificial Sequence: Synthetic oligonucleotide
auaguaauuuaucuaaugugaaaagga

SEQ ID NO: 4519 - RNA, 27 nt, Artificial Sequence
  Description of Artificial Sequence: Synthetic oligonucleotide
agucuuuauaguaauuuaucuaaugug

SEQ ID NO: 4520 - RNA, 27 nt, Artificial Sequence
  Description of Artificial Sequence: Synthetic oligonucleotide
gagucuuuauaguaauuuaucuaaugu

SEQ ID NO: 4521 - RNA, 27 nt, Artificial Sequence
  Description of Artificial Sequence: Synthetic oligonucleotide
ggagucuuuauaguaauuuaucuaaug

SEQ ID NO: 4522 - RNA, 27 nt, Artificial Sequence
  Description of Artificial Sequence: Synthetic oligonucleotide
cccauuucauacugggucugccuuaac

SEQ ID NO: 4523 - RNA, 27 nt, Artificial Sequence
  Description of Artificial Sequence: Synthetic oligonucleotide
ccccauuucauacugggucugccuuaa

SEQ ID NO: 4524 - RNA, 27 nt, Artificial Sequence
  Description of Artificial Sequence: Synthetic oligonucleotide
uccccauuucauacugggucugccuua

SEQ ID NO: 4525 - RNA, 27 nt, Artificial Sequence
  Description of Artificial Sequence: Synthetic oligonucleotide
auccccauuucauacugggucugccuu

SEQ ID NO: 4526 - RNA, 27 nt, Artificial Sequence
  Description of Artificial Sequence: Synthetic oligonucleotide
uugcuauaauaauccccauuucauacu

SEQ ID NO: 4527 - RNA, 27 nt, Artificial Sequence
  Description of Artificial Sequence: Synthetic oligonucleotide
ccaaaaugguugcuauaauaaucccca

SEQ ID NO: 4528 - RNA, 27 nt, Artificial Sequence
  Description of Artificial Sequence: Synthetic oligonucleotide
auuuaguagcauguaaauauagcccca

SEQ ID NO: 4529 - RNA, 27 nt, Artificial Sequence
  Description of Artificial Sequence: Synthetic oligonucleotide
aauuuaguagcauguaaauauagcccc

SEQ ID NO: 4530 - RNA, 27 nt, Artificial Sequence
  Description of Artificial Sequence: Synthetic oligonucleotide
aaauuuaguagcauguaaauauagccc

SEQ ID NO: 4531 - RNA, 27 nt, Artificial Sequence
  Description of Artificial Sequence: Synthetic oligonucleotide
aaaauuuaguagcauguaaauauagcc

SEQ ID NO: 4532 - RNA, 27 nt, Artificial Sequence
  Description of Artificial Sequence: Synthetic oligonucleotide
aaaaauuuaguagcauguaaauauagc

SEQ ID NO: 4533 - RNA, 27 nt, Artificial Sequence
  Description of Artificial Sequence: Synthetic oligonucleotide
uaaaaauuuaguagcauguaaauauag

SEQ ID NO: 4534 - RNA, 27 nt, Artificial Sequence
  Description of Artificial Sequence: Synthetic oligonucleotide
auaaaaauuuaguagcauguaaauaua

SEQ ID NO: 4535 - RNA, 27 nt, Artificial Sequence
  Description of Artificial Sequence: Synthetic oligonucleotide
uauaaaaauuuaguagcauguaaauau

SEQ ID NO: 4536 - RNA, 27 nt, Artificial Sequence
  Description of Artificial Sequence: Synthetic oligonucleotide
uuauaaaaauuuaguagcauguaaaua

SEQ ID NO: 4537 - RNA, 27 nt, Artificial Sequence
  Description of Artificial Sequence: Synthetic oligonucleotide
auuauaaaaauuuaguagcauguaaau

SEQ ID NO: 4538 - RNA, 27 nt, Artificial Sequence
  Description of Artificial Sequence: Synthetic oligonucleotide
uauuauaaaaauuuaguagcauguaaa

SEQ ID NO: 4539 - RNA, 27 nt, Artificial Sequence
  Description of Artificial Sequence: Synthetic oligonucleotide
aagauuuaaaguuauacuaugaaagag

SEQ ID NO: 4540 - RNA, 27 nt, Artificial Sequence
  Description of Artificial Sequence: Synthetic oligonucleotide
aagaaaagauuuaaaguuauacuauga

SEQ ID NO: 4541 - RNA, 27 nt, Artificial Sequence
  Description of Artificial Sequence: Synthetic oligonucleotide
gaagaaaagauuuaaaguuauacuaug

SEQ ID NO: 4542 - RNA, 27 nt, Artificial Sequence
  Description of Artificial Sequence: Synthetic oligonucleotide
agacucaaguugaagaaaagauuuaaa

SEQ ID NO: 4543 - RNA, 27 nt, Artificial Sequence
  Description of Artificial Sequence: Synthetic oligonucleotide
aagacucaaguugaagaaaagauuuaa

SEQ ID NO: 4544 - RNA, 27 nt, Artificial Sequence
  Description of Artificial Sequence: Synthetic oligonucleotide
uuaaaacuaucuucaaagacucaaguu

SEQ ID NO: 4545 - RNA, 27 nt, Artificial Sequence
  Description of Artificial Sequence: Synthetic oligonucleotide
aauuaaaacuaucuucaaagacucaag

SEQ ID NO: 4546 - RNA, 27 nt, Artificial Sequence
  Description of Artificial Sequence: Synthetic oligonucleotide
gaauuaaaacuaucuucaaagacucaa

SEQ ID NO: 4547 - RNA, 27 nt, Artificial Sequence
  Description of Artificial Sequence: Synthetic oligonucleotide
ugucacaagcagaauuaaaacuaucuu

SEQ ID NO: 4548 - RNA, 27 nt, Artificial Sequence
  Description of Artificial Sequence: Synthetic oligonucleotide
augucacaagcagaauuaaaacuaucu

SEQ ID NO: 4549 - RNA, 27 nt, Artificial Sequence
  Description of Artificial Sequence: Synthetic oligonucleotide
aaugucacaagcagaauuaaaacuauc

SEQ ID NO: 4550 - RNA, 27 nt, Artificial Sequence
  Description of Artificial Sequence: Synthetic oligonucleotide
ccaaauaaucuuuuaaugucacaagca

SEQ ID NO: 4551 - RNA, 27 nt, Artificial Sequence
  Description of Artificial Sequence: Synthetic oligonucleotide
caaaaucucaacuuuugaguuaauauu

SEQ ID NO: 4552 - RNA, 27 nt, Artificial Sequence
  Description of Artificial Sequence: Synthetic oligonucleotide
aaaaaaaaauuaaugucuuggcacacc

SEQ ID NO: 4553 - RNA, 27 nt, Artificial Sequence
  Description of Artificial Sequence: Synthetic oligonucleotide
uguuuaugcaauguuaauuuaaccagu

SEQ ID NO: 4554 - RNA, 27 nt, Artificial Sequence
  Description of Artificial Sequence: Synthetic oligonucleotide
guguuuaugcaauguuaauuuaaccag

SEQ ID NO: 4555 - RNA, 27 nt, Artificial Sequence
  Description of Artificial Sequence: Synthetic oligonucleotide
aguguuuaugcaauguuaauuuaacca

SEQ ID NO: 4556 - RNA, 27 nt, Artificial Sequence
  Description of Artificial Sequence: Synthetic oligonucleotide
cagacuugaaaaguguuuaugcaaugu

SEQ ID NO: 4557 - RNA, 27 nt, Artificial Sequence
  Description of Artificial Sequence: Synthetic oligonucleotide
gcauuauuaaauauggaucagacuuga

SEQ ID NO: 4558 - RNA, 27 nt, Artificial Sequence
  Description of Artificial Sequence: Synthetic oligonucleotide
augccaucucacuucauuuauuuuaaa

SEQ ID NO: 4559 - RNA, 27 nt, Artificial Sequence
  Description of Artificial Sequence: Synthetic oligonucleotide
caugccaucucacuucauuuauuuuaa

SEQ ID NO: 4560 - RNA, 27 nt, Artificial Sequence
  Description of Artificial Sequence: Synthetic oligonucleotide
aaaauuuacagauugugcugagcuuga

SEQ ID NO: 4561 - RNA, 27 nt, Artificial Sequence
  Description of Artificial Sequence: Synthetic oligonucleotide
aaaaauuuacagauugugcugagcuug

SEQ ID NO: 4562 - RNA, 27 nt, Artificial Sequence
  Description of Artificial Sequence: Synthetic oligonucleotide
auuguccuaaaagaaucacaguuaugc

SEQ ID NO: 4563 - RNA, 27 nt, Artificial Sequence
  Description of Artificial Sequence: Synthetic oligonucleotide
caguaauuguccuaaaagaaucacagu

SEQ ID NO: 4564 - RNA, 27 nt, Artificial Sequence
  Description of Artificial Sequence: Synthetic oligonucleotide
acaguaauuguccuaaaagaaucacag

SEQ ID NO: 4565 - RNA, 27 nt, Artificial Sequence
  Description of Artificial Sequence: Synthetic oligonucleotide
ggucaauaugaauaucugacauacacc

SEQ ID NO: 4566 - RNA, 27 nt, Artificial Sequence
  Description of Artificial Sequence: Synthetic oligonucleotide
gggucaauaugaauaucugacauacac

SEQ ID NO: 4567 - RNA, 27 nt, Artificial Sequence
  Description of Artificial Sequence: Synthetic oligonucleotide
agagaaaacuggaauauuacacauuug

SEQ ID NO: 4568 - RNA, 27 nt, Artificial Sequence
  Description of Artificial Sequence: Synthetic oligonucleotide
uuagguucuaaauuccuaugcagugug

SEQ ID NO: 4569 - RNA, 27 nt, Artificial Sequence
  Description of Artificial Sequence: Synthetic oligonucleotide
auuaggacaaaauugugcaauggugac

SEQ ID NO: 4570 - RNA, 27 nt, Artificial Sequence
  Description of Artificial Sequence: Synthetic oligonucleotide
uauuaggacaaaauugugcaaugguga

SEQ ID NO: 4571 - RNA, 27 nt, Artificial Sequence
  Description of Artificial Sequence: Synthetic oligonucleotide
auauuaggacaaaauugugcaauggug

SEQ ID NO: 4572 - RNA, 27 nt, Artificial Sequence
  Description of Artificial Sequence: Synthetic oligonucleotide
uauauuaggacaaaauugugcaauggu

SEQ ID NO: 4573 - RNA, 27 nt, Artificial Sequence
  Description of Artificial Sequence: Synthetic oligonucleotide
auauauuaggacaaaauugugcaaugg

SEQ ID NO: 4574 - RNA, 27 nt, Artificial Sequence
  Description of Artificial Sequence: Synthetic oligonucleotide
uauauauuaggacaaaauugugcaaug

SEQ ID NO: 4575 - RNA, 27 nt, Artificial Sequence
  Description of Artificial Sequence: Synthetic oligonucleotide
guuucucaaugcagaauucaugcuauc

SEQ ID NO: 4576 - RNA, 27 nt, Artificial Sequence
  Description of Artificial Sequence: Synthetic oligonucleotide
aguuucucaaugcagaauucaugcuau

SEQ ID NO: 4577 - RNA, 27 nt, Artificial Sequence
  Description of Artificial Sequence: Synthetic oligonucleotide
cauuaucccaaacaggcacuucaaacu

SEQ ID NO: 4578 - RNA, 27 nt, Artificial Sequence
  Description of Artificial Sequence: Synthetic oligonucleotide
ucauuaucccaaacaggcacuucaaac

SEQ ID NO: 4579 - RNA, 27 nt, Artificial Sequence
  Description of Artificial Sequence: Synthetic oligonucleotide
aucauuaucccaaacaggcacuucaaa

SEQ ID NO: 4580 - RNA, 27 nt, Artificial Sequence
  Description of Artificial Sequence: Synthetic oligonucleotide
uacuaguaagaaauuggcacucaaagg

SEQ ID NO: 4581 - RNA, 27 nt, Artificial Sequence
  Description of Artificial Sequence: Synthetic oligonucleotide
guacuaguaagaaauuggcacucaaag

SEQ ID NO: 4582 - RNA, 27 nt, Artificial Sequence
  Description of Artificial Sequence: Synthetic oligonucleotide
aguacuaguaagaaauuggcacucaaa

SEQ ID NO: 4583 - RNA, 27 nt, Artificial Sequence
  Description of Artificial Sequence: Synthetic oligonucleotide
uaguacuaguaagaaauuggcacucaa

SEQ ID NO: 4584 - RNA, 27 nt, Artificial Sequence
  Description of Artificial Sequence: Synthetic oligonucleotide
auaguacuaguaagaaauuggcacuca

SEQ ID NO: 4585 - RNA, 27 nt, Artificial Sequence
  Description of Artificial Sequence: Synthetic oligonucleotide
aauaguacuaguaagaaauuggcacuc

SEQ ID NO: 4586 - RNA, 27 nt, Artificial Sequence
  Description of Artificial Sequence: Synthetic oligonucleotide
cuauacaaaaauaguuaaaauacauuc

SEQ ID NO: 4587 - RNA, 27 nt, Artificial Sequence
  Description of Artificial Sequence: Synthetic oligonucleotide
acuauacaaaaauaguuaaaauacauu

SEQ ID NO: 4588 - RNA, 27 nt, Artificial Sequence
  Description of Artificial Sequence: Synthetic oligonucleotide
ucaguuuacacuauacaaaaauaguua

SEQ ID NO: 4589 - RNA, 27 nt, Artificial Sequence
  Description of Artificial Sequence: Synthetic oligonucleotide
uucaguuuacacuauacaaaaauaguu

SEQ ID NO: 4590 - RNA, 27 nt, Artificial Sequence
  Description of Artificial Sequence: Synthetic oligonucleotide
uuucaguuuacacuauacaaaaauagu

SEQ ID NO: 4591 - RNA, 27 nt, Artificial Sequence
  Description of Artificial Sequence: Synthetic oligonucleotide
guuucaguuuacacuauacaaaaauag

SEQ ID NO: 4592 - RNA, 27 nt, Artificial Sequence
  Description of Artificial Sequence: Synthetic oligonucleotide
uguuucaguuuacacuauacaaaaaua

SEQ ID NO: 4593 - RNA, 27 nt, Artificial Sequence
  Description of Artificial Sequence: Synthetic oligonucleotide
auguuucaguuuacacuauacaaaaau

SEQ ID NO: 4594 - RNA, 27 nt, Artificial Sequence
  Description of Artificial Sequence: Synthetic oligonucleotide
gcacaauguacaaaaugugcauguuuc

SEQ ID NO: 4595 - RNA, 27 nt, Artificial Sequence
  Description of Artificial Sequence: Synthetic oligonucleotide
agcacaauguacaaaaugugcauguuu

SEQ ID NO: 4596 - RNA, 27 nt, Artificial Sequence
  Description of Artificial Sequence: Synthetic oligonucleotide
gaaagcacaauguacaaaaugugcaug

SEQ ID NO: 4597 - RNA, 27 nt, Artificial Sequence
  Description of Artificial Sequence: Synthetic oligonucleotide
agaaagcacaauguacaaaaugugcau

SEQ ID NO: 4598 - RNA, 27 nt, Artificial Sequence
  Description of Artificial Sequence: Synthetic oligonucleotide
aagaaagcacaauguacaaaaugugca

SEQ ID NO: 4599 - RNA, 27 nt, Artificial Sequence
  Description of Artificial Sequence: Synthetic oligonucleotide
aaagaaagcacaauguacaaaaugugc

SEQ ID NO: 4600 - RNA, 27 nt, Artificial Sequence
  Description of Artificial Sequence: Synthetic oligonucleotide
aaaagaaagcacaauguacaaaaugug

SEQ ID NO: 4601 - RNA, 27 nt, Artificial Sequence
  Description of Artificial Sequence: Synthetic oligonucleotide
caaaagaaagcacaauguacaaaaugu

SEQ ID NO: 4602 - RNA, 27 nt, Artificial Sequence
  Description of Artificial Sequence: Synthetic oligonucleotide
acaaaagaaagcacaauguacaaaaug

SEQ ID NO: 4603 - RNA, 27 nt, Artificial Sequence
  Description of Artificial Sequence: Synthetic oligonucleotide
acuggaucacacugcauaugucccaca

SEQ ID NO: 4604 - RNA, 27 nt, Artificial Sequence
  Description of Artificial Sequence: Synthetic oligonucleotide
aacuggaucacacugcauaugucccac

SEQ ID NO: 4605 - RNA, 27 nt, Artificial Sequence
  Description of Artificial Sequence: Synthetic oligonucleotide
caacuggaucacacugcauauguccca

SEQ ID NO: 4606 - RNA, 27 nt, Artificial Sequence
  Description of Artificial Sequence: Synthetic oligonucleotide
acaacuggaucacacugcauauguccc

SEQ ID NO: 4607 - RNA, 27 nt, Artificial Sequence
  Description of Artificial Sequence: Synthetic oligonucleotide
aacaacuggaucacacugcauaugucc

SEQ ID NO: 4608 - RNA, 27 nt, Artificial Sequence
  Description of Artificial Sequence: Synthetic oligonucleotide
aaacaacuggaucacacugcauauguc

SEQ ID NO: 4609 - RNA, 27 nt, Artificial Sequence
  Description of Artificial Sequence: Synthetic oligonucleotide
aaaacaacuggaucacacugcauaugu

SEQ ID NO: 4610 - RNA, 27 nt, Artificial Sequence
  Description of Artificial Sequence: Synthetic oligonucleotide
gaaaacaacuggaucacacugcauaug

SEQ ID NO: 4611 - RNA, 27 nt, Artificial Sequence
  Description of Artificial Sequence: Synthetic oligonucleotide
ggaaaacaacuggaucacacugcauau

SEQ ID NO: 4612 - RNA, 27 nt, Artificial Sequence
  Description of Artificial Sequence: Synthetic oligonucleotide
ugauggaaaacaacuggaucacacugc

SEQ ID NO: 4613 - RNA, 27 nt, Artificial Sequence
  Description of Artificial Sequence: Synthetic oligonucleotide
augauggaaaacaacuggaucacacug

SEQ ID NO: 4614 - RNA, 27 nt, Artificial Sequence
  Description of Artificial Sequence: Synthetic oligonucleotide
aaugauggaaaacaacuggaucacacu

SEQ ID NO: 4615 - RNA, 27 nt, Artificial Sequence
  Description of Artificial Sequence: Synthetic oligonucleotide
aaaugauggaaaacaacuggaucacac

SEQ ID NO: 4616 - RNA, 27 nt, Artificial Sequence
  Description of Artificial Sequence: Synthetic oligonucleotide
caaaugauggaaaacaacuggaucaca

SEQ ID NO: 4617 - RNA, 27 nt, Artificial Sequence
  Description of Artificial Sequence: Synthetic oligonucleotide
ccaaaugauggaaaacaacuggaucac

SEQ ID NO: 4618 - RNA, 27 nt, Artificial Sequence
  Description of Artificial Sequence: Synthetic oligonucleotide
acauuccuaggucagcgcaaccaaaug

SEQ ID NO: 4619 - RNA, 27 nt, Artificial Sequence
  Description of Artificial Sequence: Synthetic oligonucleotide
aacauuccuaggucagcgcaaccaaau

SEQ ID NO: 4620 - RNA, 27 nt, Artificial Sequence
  Description of Artificial Sequence: Synthetic oligonucleotide
uaauguuugauaugaccaacauuccua

SEQ ID NO: 4621 - RNA, 27 nt, Artificial Sequence
  Description of Artificial Sequence: Synthetic oligonucleotide
uuaauguuugauaugaccaacauuccu

SEQ ID NO: 4622 - RNA, 27 nt, Artificial Sequence
  Description of Artificial Sequence: Synthetic oligonucleotide
uuuaauguuugauaugaccaacauucc

SEQ ID NO: 4623 - RNA, 27 nt, Artificial Sequence
  Description of Artificial Sequence: Synthetic oligonucleotide
uuuuaauguuugauaugaccaacauuc

SEQ ID NO: 4624 - RNA, 27 nt, Artificial Sequence
  Description of Artificial Sequence: Synthetic oligonucleotide
uuuuuaauguuugauaugaccaacauu

SEQ ID NO: 4625 - RNA, 27 nt, Artificial Sequence
  Description of Artificial Sequence: Synthetic oligonucleotide
auuuuuaauguuugauaugaccaacau

SEQ ID NO: 4626 - RNA, 27 nt, Artificial Sequence
  Description of Artificial Sequence: Synthetic oligonucleotide
cauuuuuaauguuugauaugaccaaca

SEQ ID NO: 4627 - RNA, 27 nt, Artificial Sequence
  Description of Artificial Sequence: Synthetic oligonucleotide
ucauuuuuaauguuugauaugaccaac

SEQ ID NO: 4628 - RNA, 27 nt, Artificial Sequence
  Description of Artificial Sequence: Synthetic oligonucleotide
gucauuuuuaauguuugauaugaccaa

SEQ ID NO: 4629 - RNA, 27 nt, Artificial Sequence
  Description of Artificial Sequence: Synthetic oligonucleotide
ccuauaaacauuuaaaaguuaauuuca

SEQ ID NO: 4630 - RNA, 27 nt, Artificial Sequence
  Description of Artificial Sequence: Synthetic oligonucleotide
uccuauaaacauuuaaaaguuaauuuc

SEQ ID NO: 4631 - RNA, 27 nt, Artificial Sequence
  Description of Artificial Sequence: Synthetic oligonucleotide
auacuccuauaaacauuuaaaaguuaa

SEQ ID NO: 4632 - RNA, 27 nt, Artificial Sequence
  Description of Artificial Sequence: Synthetic oligonucleotide
cauacuccuauaaacauuuaaaaguua

SEQ ID NO: 4633 - RNA, 27 nt, Artificial Sequence
  Description of Artificial Sequence: Synthetic oligonucleotide
acauacuccuauaaacauuuaaaaguu

SEQ ID NO: 4634 - RNA, 27 nt, Artificial Sequence
  Description of Artificial Sequence: Synthetic oligonucleotide
cacauacuccuauaaacauuuaaaagu

SEQ ID NO: 4635 - RNA, 27 nt, Artificial Sequence
  Description of Artificial Sequence: Synthetic oligonucleotide
gcacauacuccuauaaacauuuaaaag

SEQ ID NO: 4636 - RNA, 27 nt, Artificial Sequence
  Description of Artificial Sequence: Synthetic oligonucleotide
agcacauacuccuauaaacauuuaaaa

SEQ ID NO: 4637 - RNA, 27 nt, Artificial Sequence
  Description of Artificial Sequence: Synthetic oligonucleotide
uucaugacaaaaauauuacaaauuuua

SEQ ID NO: 4638 - RNA, 27 nt, Artificial Sequence
  Description of Artificial Sequence: Synthetic oligonucleotide
guucaugacaaaaauauuacaaauuuu

SEQ ID NO: 4639 - RNA, 27 nt, Artificial Sequence
  Description of Artificial Sequence: Synthetic oligonucleotide
aguucaugacaaaaauauuacaaauuu

SEQ ID NO: 4640 - RNA, 27 nt, Artificial Sequence
  Description of Artificial Sequence: Synthetic oligonucleotide
caguucaugacaaaaauauuacaaauu

SEQ ID NO: 4641 - RNA, 27 nt, Artificial Sequence
  Description of Artificial Sequence: Synthetic oligonucleotide
acaguucaugacaaaaauauuacaaau

SEQ ID NO: 4642 - RNA, 27 nt, Artificial Sequence
  Description of Artificial Sequence: Synthetic oligonucleotide
uacaguucaugacaaaaauauuacaaa

SEQ ID NO: 4643 - RNA, 27 nt, Artificial Sequence
  Description of Artificial Sequence: Synthetic oligonucleotide
guacaguucaugacaaaaauauuacaa

SEQ ID NO: 4644 - RNA, 27 nt, Artificial Sequence
  Description of Artificial Sequence: Synthetic oligonucleotide
aguacaguucaugacaaaaauauuaca

SEQ ID NO: 4645 - RNA, 27 nt, Artificial Sequence
  Description of Artificial Sequence: Synthetic oligonucleotide
guaacuauuuuuauuacauuacaauaa

SEQ ID NO: 4646 - RNA, 27 nt, Artificial Sequence
  Description of Artificial Sequence: Synthetic oligonucleotide
uguaacuauuuuuauuacauuacaaua

SEQ ID NO: 4647 - RNA, 27 nt, Artificial Sequence
  Description of Artificial Sequence: Synthetic oligonucleotide
cuguaacuauuuuuauuacauuacaau

SEQ ID NO: 4648 - RNA, 27 nt, Artificial Sequence
  Description of Artificial Sequence: Synthetic oligonucleotide
acuguaacuauuuuuauuacauuacaa

SEQ ID NO: 4649 - RNA, 27 nt, Artificial Sequence
  Description of Artificial Sequence: Synthetic oligonucleotide
cacuguaacuauuuuuauuacauuaca

SEQ ID NO: 4650 - DNA, 25 bp, Artificial Sequence
  Description of Artificial Sequence: Synthetic oligonucleotide
  Description of Combined DNA/RNA Molecule: Synthetic oligonucleotide
gaggccugcugaaaaugacugaata

SEQ ID NO: 4651 - DNA, 25 bp, Artificial Sequence
  Description of Artificial Sequence: Synthetic oligonucleotide
  Description of Combined DNA/RNA Molecule: Synthetic oligonucleotide
aggccugcugaaaaugacugaauat

SEQ ID NO: 4652 - DNA, 25 bp, Artificial Sequence
  Description of Artificial Sequence: Synthetic oligonucleotide
  Description of Combined DNA/RNA Molecule: Synthetic oligonucleotide
ggccugcugaaaaugacugaauata

SEQ ID NO: 4653 - RNA, 25 nt, Artificial Sequence
  Description of Artificial Sequence: Synthetic oligonucleotide
gccugcugaaaaugacugaauauaa

SEQ ID NO: 4654 - RNA, 25 nt, Artificial Sequence
  Description of Artificial Sequence: Synthetic oligonucleotide
guuggagcugguggcguaggcaaga

SEQ ID NO: 4655 - RNA, 25 nt, Artificial Sequence
  Description of Artificial Sequence: Synthetic oligonucleotide
uuggagcugguggcguaggcaagag

SEQ ID NO: 4656 - DNA, 25 bp, Artificial Sequence
  Description of Artificial Sequence: Synthetic oligonucleotide
  Description of Combined DNA/RNA Molecule: Synthetic oligonucleotide
uggagcugguggcguaggcaagagt

SEQ ID NO: 4657 - DNA, 25 bp, Artificial Sequence
  Description of Artificial Sequence: Synthetic oligonucleotide
  Description of Combined DNA/RNA Molecule: Synthetic oligonucleotide
ggagcugguggcguaggcaagagtg

SEQ ID NO: 4658 - RNA, 25 nt, Artificial Sequence
  Description of Artificial Sequence: Synthetic oligonucleotide
gagcugguggcguaggcaagagugc

SEQ ID NO: 4659 - RNA, 25 nt, Artificial Sequence
  Description of Artificial Sequence: Synthetic oligonucleotide
agcugguggcguaggcaagagugcc

SEQ ID NO: 4660 - DNA, 25 bp, Artificial Sequence
  Description of Artificial Sequence: Synthetic oligonucleotide
  Description of Combined DNA/RNA Molecule: Synthetic oligonucleotide
gcugguggcguaggcaagagugcct

SEQ ID NO: 4661 - DNA, 25 bp, Artificial Sequence
  Description of Artificial Sequence: Synthetic oligonucleotide
  Description of Combined DNA/RNA Molecule: Synthetic oligonucleotide
uacagcuaauucagaaucauuuugt

SEQ ID NO: 4662 - DNA, 25 bp, Artificial Sequence
  Description of Artificial Sequence: Synthetic oligonucleotide
  Description of Artificial Sequence: Synthetic oligonucleotide
uaauugauggagaaaccugucuctt

SEQ ID NO: 4663 - DNA, 25 bp, Artificial Sequence
  Description of Artificial Sequence: Synthetic oligonucleotide
  Description of Combined DNA/RNA Molecule: Synthetic oligonucleotide
aauugauggagaaaccugucucutg

SEQ ID NO: 4664 - DNA, 25 bp, Artificial Sequence
  Description of Artificial Sequence: Synthetic oligonucleotide
  Description of Combined DNA/RNA Molecule: Synthetic oligonucleotide
gauggagaaaccugucucuuggata

SEQ ID NO: 4665 - RNA, 25 nt, Artificial Sequence
  Description of Artificial Sequence: Synthetic oligonucleotide
ccugucucuuggauauucucgacac

SEQ ID NO: 4666 - RNA, 25 nt, Artificial Sequence
  Description of Artificial Sequence: Synthetic oligonucleotide
ugucucuuggauauucucgacacag

SEQ ID NO: 4667 - RNA, 25 nt, Artificial Sequence
  Description of Artificial Sequence: Synthetic oligonucleotide
gucucuuggauauucucgacacagc

SEQ ID NO: 4668 - RNA, 25 nt, Artificial Sequence
  Description of Artificial Sequence: Synthetic oligonucleotide
ucucuuggauauucucgacacagca

SEQ ID NO: 4669 - RNA, 25 nt, Artificial Sequence
  Description of Artificial Sequence: Synthetic oligonucleotide
cucuuggauauucucgacacagcag

SEQ ID NO: 4670 - RNA, 25 nt, Artificial Sequence
  Description of Artificial Sequence: Synthetic oligonucleotide
ucuuggauauucucgacacagcagg

SEQ ID NO: 4671 - DNA, 25 bp, Artificial Sequence
  Description of Artificial Sequence: Synthetic oligonucleotide
  Description of Combined DNA/RNA Molecule: Synthetic oligonucleotide
cuuggauauucucgacacagcaggt

SEQ ID NO: 4672 - DNA, 25 bp, Artificial Sequence
  Description of Artificial Sequence: Synthetic oligonucleotide
  Description of Combined DNA/RNA Molecule: Synthetic oligonucleotide
uuggauauucucgacacagcaggtc

SEQ ID NO: 4673 - RNA, 25 nt, Artificial Sequence
  Description of Artificial Sequence: Synthetic oligonucleotide
cagcaggucaagaggaguacagugc

SEQ ID NO: 4674 - RNA, 25 nt, Artificial Sequence
  Description of Artificial Sequence: Synthetic oligonucleotide
agcaggucaagaggaguacagugca

SEQ ID NO: 4675 - RNA, 25 nt, Artificial Sequence
  Description of Artificial Sequence: Synthetic oligonucleotide
gcaggucaagaggaguacagugcaa

SEQ ID NO: 4676 - RNA, 25 nt, Artificial Sequence
  Description of Artificial Sequence: Synthetic oligonucleotide
aggaguacagugcaaugagggacca

SEQ ID NO: 4677 - RNA, 25 nt, Artificial Sequence
  Description of Artificial Sequence: Synthetic oligonucleotide
ggaguacagugcaaugagggaccag

SEQ ID NO: 4678 - DNA, 25 bp, Artificial Sequence
  Description of Artificial Sequence: Synthetic oligonucleotide
  Description of Combined DNA/RNA Molecule: Synthetic oligonucleotide
gaguacagugcaaugagggaccagt

SEQ ID NO: 4679 - DNA, 25 bp, Artificial Sequence
  Description of Artificial Sequence: Synthetic oligonucleotide
  Description of Combined DNA/RNA Molecule: Synthetic oligonucleotide
aguacagugcaaugagggaccagta

SEQ ID NO: 4680 - RNA, 25 nt, Artificial Sequence
  Description of Artificial Sequence: Synthetic oligonucleotide
guacagugcaaugagggaccaguac

SEQ ID NO: 4681 - RNA, 25 nt, Artificial Sequence
  Description of Artificial Sequence: Synthetic oligonucleotide
uacagugcaaugagggaccaguaca

SEQ ID NO: 4682 - DNA, 25 bp, Artificial Sequence
  Description of Artificial Sequence: Synthetic oligonucleotide
  Description of Combined DNA/RNA Molecule: Synthetic oligonucleotide
acagugcaaugagggaccaguacat

SEQ ID NO: 4683 - DNA, 25 bp, Artificial Sequence
  Description of Artificial Sequence: Synthetic oligonucleotide
  Description of Combined DNA/RNA Molecule: Synthetic oligonucleotide
cagugcaaugagggaccaguacatg

SEQ ID NO: 4684 - RNA, 25 nt, Artificial Sequence
  Description of Artificial Sequence: Synthetic oligonucleotide
agugcaaugagggaccaguacauga

SEQ ID NO: 4685 - DNA, 25 bp, Artificial Sequence
  Description of Artificial Sequence: Synthetic oligonucleotide
  Description of Combined DNA/RNA Molecule: Synthetic oligonucleotide
guauuugccauaaauaauacuaaat

SEQ ID NO: 4686 - DNA, 25 bp, Artificial Sequence
  Description of Artificial Sequence: Synthetic oligonucleotide
  Description of Combined DNA/RNA Molecule: Synthetic oligonucleotide
uauuugccauaaauaauacuaaatc

SEQ ID NO: 4687 - RNA, 25 nt, Artificial Sequence
  Description of Artificial Sequence: Synthetic oligonucleotide
auuugccauaaauaauacuaaauca

SEQ ID NO: 4688 - DNA, 25 bp, Artificial Sequence
  Description of Artificial Sequence: Synthetic oligonucleotide
  Description of Combined DNA/RNA Molecule: Synthetic oligonucleotide
uuugccauaaauaauacuaaaucat

SEQ ID NO: 4689 - DNA, 25 bp, Artificial Sequence
  Description of Artificial Sequence: Synthetic oligonucleotide
  Description of Combined DNA/RNA Molecule: Synthetic oligonucleotide
uugccauaaauaauacuaaaucatt

SEQ ID NO: 4690 - DNA, 25 bp, Artificial Sequence
  Description of Artificial Sequence: Synthetic oligonucleotide
  Description of Combined DNA/RNA Molecule: Synthetic oligonucleotide
ugccauaaauaauacuaaaucautt

SEQ ID NO: 4691 - DNA, 25 bp, Artificial Sequence
  Description of Artificial Sequence: Synthetic oligonucleotide
  Description of Combined DNA/RNA Molecule: Synthetic oligonucleotide
gccauaaauaauacuaaaucauutg

SEQ ID NO: 4692 - RNA, 25 nt, Artificial Sequence
  Description of Artificial Sequence: Synthetic oligonucleotide
auacuaaaucauuugaagauauuca

SEQ ID NO: 4693 - RNA, 25 nt, Artificial Sequence
  Description of Artificial Sequence: Synthetic oligonucleotide
uacuaaaucauuugaagauauucac

SEQ ID NO: 4694 - RNA, 25 nt, Artificial Sequence
  Description of Artificial Sequence: Synthetic oligonucleotide
acuaaaucauuugaagauauucacc

SEQ ID NO: 4695 - RNA, 25 nt, Artificial Sequence
  Description of Artificial Sequence: Synthetic oligonucleotide
cuaaaucauuugaagauauucacca

SEQ ID NO: 4696 - DNA, 25 bp, Artificial Sequence
  Description of Artificial Sequence: Synthetic oligonucleotide
  Description of Combined DNA/RNA Molecule: Synthetic oligonucleotide
uaaaucauuugaagauauucaccat

SEQ ID NO: 4697 - DNA, 25 bp, Artificial Sequence
  Description of Artificial Sequence: Synthetic oligonucleotide
  Description of Combined DNA/RNA Molecule: Synthetic oligonucleotide
aaaucauuugaagauauucaccatt

SEQ ID NO: 4698 - DNA, 25 bp, Artificial Sequence
  Description of Artificial Sequence: Synthetic oligonucleotide
  Description of Combined DNA/RNA Molecule: Synthetic oligonucleotide
aaucauuugaagauauucaccauta

SEQ ID NO: 4699 - DNA, 25 bp, Artificial Sequence
  Description of Artificial Sequence: Synthetic oligonucleotide
  Description of Combined DNA/RNA Molecule: Synthetic oligonucleotide
aucauuugaagauauucaccauuat

SEQ ID NO: 4700 - DNA, 25 bp, Artificial Sequence
  Description of Artificial Sequence: Synthetic oligonucleotide
  Description of Combined DNA/RNA Molecule: Synthetic oligonucleotide
ucauuugaagauauucaccauuata

SEQ ID NO: 4701 - DNA, 25 bp, Artificial Sequence
  Description of Artificial Sequence: Synthetic oligonucleotide
  Description of Combined DNA/RNA Molecule: Synthetic oligonucleotide
auauucaccauuauagagaacaaat

SEQ ID NO: 4702 - DNA, 25 bp, Artificial Sequence
  Description of Artificial Sequence: Synthetic oligonucleotide
  Description of Combined DNA/RNA Molecule: Synthetic oligonucleotide
uauucaccauuauagagaacaaatt

SEQ ID NO: 4703 - DNA, 25 bp, Artificial Sequence
  Description of Artificial Sequence: Synthetic oligonucleotide
  Description of Combined DNA/RNA Molecule: Synthetic oligonucleotide
auucaccauuauagagaacaaauta

SEQ ID NO: 4704 - RNA, 25 nt, Artificial Sequence
  Description of Artificial Sequence: Synthetic oligonucleotide
uucaccauuauagagaacaaauuaa

SEQ ID NO: 4705 - RNA, 25 nt, Artificial Sequence
  Description of Artificial Sequence: Synthetic oligonucleotide
ucaccauuauagagaacaaauuaaa

SEQ ID NO: 4706 - RNA, 25 nt, Artificial Sequence
  Description of Artificial Sequence: Synthetic oligonucleotide
caccauuauagagaacaaauuaaaa

SEQ ID NO: 4707 - RNA, 25 nt, Artificial Sequence
  Description of Artificial Sequence: Synthetic oligonucleotide
accauuauagagaacaaauuaaaag

SEQ ID NO: 4708 - RNA, 25 nt, Artificial Sequence
  Description of Artificial Sequence: Synthetic oligonucleotide
ccauuauagagaacaaauuaaaaga

SEQ ID NO: 4709 - RNA, 25 nt, Artificial Sequence
  Description of Artificial Sequence: Synthetic oligonucleotide
cauuauagagaacaaauuaaaagag

SEQ ID NO: 4710 - DNA, 25 bp, Artificial Sequence
  Description of Artificial Sequence: Synthetic oligonucleotide
  Description of Combined DNA/RNA Molecule: Synthetic oligonucleotide
cuaugguccuaguaggaaauaaatg

SEQ ID NO: 4711 - RNA, 25 nt, Artificial Sequence
  Description of Artificial Sequence: Synthetic oligonucleotide
ugugauuugccuucuagaacaguag

SEQ ID NO: 4712 - RNA, 25 nt, Artificial Sequence
  Description of Artificial Sequence: Synthetic oligonucleotide
gugauuugccuucuagaacaguaga

SEQ ID NO: 4713 - RNA, 25 nt, Artificial Sequence
  Description of Artificial Sequence: Synthetic oligonucleotide
gauuugccuucuagaacaguagaca

SEQ ID NO: 4714 - RNA, 25 nt, Artificial Sequence
  Description of Artificial Sequence: Synthetic oligonucleotide
guuauggaauuccuuuuauugaaac

SEQ ID NO: 4715 - RNA, 25 nt, Artificial Sequence
  Description of Artificial Sequence: Synthetic oligonucleotide
uuauggaauuccuuuuauugaaaca

SEQ ID NO: 4716 - DNA, 25 bp, Artificial Sequence
  Description of Artificial Sequence: Synthetic oligonucleotide
  Description of Combined DNA/RNA Molecule: Synthetic oligonucleotide
uauggaauuccuuuuauugaaacat

SEQ ID NO: 4717 - RNA, 25 nt, Artificial Sequence
  Description of Artificial Sequence: Synthetic oligonucleotide
gaugccuucuauacauuaguucgag

SEQ ID NO: 4718 - RNA, 25 nt, Artificial Sequence
  Description of Artificial Sequence: Synthetic oligonucleotide
augccuucuauacauuaguucgaga

SEQ ID NO: 4719 - RNA, 25 nt, Artificial Sequence
  Description of Artificial Sequence: Synthetic oligonucleotide
cgagaaauucgaaaacauaaagaaa

SEQ ID NO: 4720 - RNA, 25 nt, Artificial Sequence
  Description of Artificial Sequence: Synthetic oligonucleotide
gaaaacauaaagaaaagaugagcaa

SEQ ID NO: 4721 - RNA, 25 nt, Artificial Sequence
  Description of Artificial Sequence: Synthetic oligonucleotide
aaaacauaaagaaaagaugagcaaa

SEQ ID NO: 4722 - RNA, 25 nt, Artificial Sequence
  Description of Artificial Sequence: Synthetic oligonucleotide
aaacauaaagaaaagaugagcaaag

SEQ ID NO: 4723 - RNA, 25 nt, Artificial Sequence
  Description of Artificial Sequence: Synthetic oligonucleotide
aacauaaagaaaagaugagcaaaga

SEQ ID NO: 4724 - DNA, 25 bp, Artificial Sequence
  Description of Artificial Sequence: Synthetic oligonucleotide
  Description of Combined DNA/RNA Molecule: Synthetic oligonucleotide
acauaaagaaaagaugagcaaagat

SEQ ID NO: 4725 - DNA, 25 bp, Artificial Sequence
  Description of Artificial Sequence: Synthetic oligonucleotide
  Description of Combined DNA/RNA Molecule: Synthetic oligonucleotide
cauaaagaaaagaugagcaaagatg

SEQ ID NO: 4726 - RNA, 25 nt, Artificial Sequence
  Description of Artificial Sequence: Synthetic oligonucleotide
auaaagaaaagaugagcaaagaugg

SEQ ID NO: 4727 - DNA, 25 bp, Artificial Sequence
  Description of Artificial Sequence: Synthetic oligonucleotide
  Description of Combined DNA/RNA Molecule: Synthetic oligonucleotide
uaaagaaaagaugagcaaagauggt

SEQ ID NO: 4728 - DNA, 25 bp, Artificial Sequence
  Description of Artificial Sequence: Synthetic oligonucleotide
  Description of Combined DNA/RNA Molecule: Synthetic oligonucleotide
aaagaaaagaugagcaaagauggta

SEQ ID NO: 4729 - RNA, 25 nt, Artificial Sequence
  Description of Artificial Sequence: Synthetic oligonucleotide
aagugguaauuuuuguacauuacac

SEQ ID NO: 4730 - DNA, 25 bp, Artificial Sequence
  Description of Artificial Sequence: Synthetic oligonucleotide
  Description of Combined DNA/RNA Molecule: Synthetic oligonucleotide
agugguaauuuuuguacauuacact

SEQ ID NO: 4731 - RNA, 25 nt, Artificial Sequence
  Description of Artificial Sequence: Synthetic oligonucleotide
uuguacauuacacuaaauuauuagc

SEQ ID NO: 4732 - RNA, 25 nt, Artificial Sequence
  Description of Artificial Sequence: Synthetic oligonucleotide
uguacauuacacuaaauuauuagca

SEQ ID NO: 4733 - DNA, 25 bp, Artificial Sequence
  Description of Artificial Sequence: Synthetic oligonucleotide
  Description of Combined DNA/RNA Molecule: Synthetic oligonucleotide
guacauuacacuaaauuauuagcat

SEQ ID NO: 4734 - DNA, 25 bp, Artificial Sequence
  Description of Artificial Sequence: Synthetic oligonucleotide
  Description of Combined DNA/RNA Molecule: Synthetic oligonucleotide
uacauuacacuaaauuauuagcatt

SEQ ID NO: 4735 - DNA, 25 bp, Artificial Sequence
  Description of Artificial Sequence: Synthetic oligonucleotide
  Description of Combined DNA/RNA Molecule: Synthetic oligonucleotide
acauuacacuaaauuauuagcautt

SEQ ID NO: 4736 - DNA, 25 bp, Artificial Sequence
  Description of Artificial Sequence: Synthetic oligonucleotide
  Description of Combined DNA/RNA Molecule: Synthetic oligonucleotide
cauuacacuaaauuauuagcauutg

SEQ ID NO: 4737 - DNA, 25 bp, Artificial Sequence
  Description of Artificial Sequence: Synthetic oligonucleotide
  Description of Combined DNA/RNA Molecule: Synthetic oligonucleotide
auuacacuaaauuauuagcauuugt

SEQ ID NO: 4738 - DNA, 25 bp, Artificial Sequence
  Description of Artificial Sequence: Synthetic oligonucleotide
  Description of Combined DNA/RNA Molecule: Synthetic oligonucleotide
uuacacuaaauuauuagcauuugtt

SEQ ID NO: 4739 - DNA, 25 bp, Artificial Sequence
  Description of Artificial Sequence: Synthetic oligonucleotide
  Description of Combined DNA/RNA Molecule: Synthetic oligonucleotide
uacacuaaauuauuagcauuugutt

SEQ ID NO: 4740 - RNA, 25 nt, Artificial Sequence
  Description of Artificial Sequence: Synthetic oligonucleotide
uauuagcauuuguuuuagcauuacc

SEQ ID NO: 4741 - DNA, 25 bp, Artificial Sequence
  Description of Artificial Sequence: Synthetic oligonucleotide
  Description of Combined DNA/RNA Molecule: Synthetic oligonucleotide
auuagcauuuguuuuagcauuacct

SEQ ID NO: 4742 - DNA, 25 bp, Artificial Sequence
  Description of Artificial Sequence: Synthetic oligonucleotide
  Description of Combined DNA/RNA Molecule: Synthetic oligonucleotide
uuagcauuuguuuuagcauuaccta

SEQ ID NO: 4743 - RNA, 25 nt, Artificial Sequence
  Description of Artificial Sequence: Synthetic oligonucleotide
uagcauuuguuuuagcauuaccuaa

SEQ ID NO: 4744 - DNA, 25 bp, Artificial Sequence
  Description of Artificial Sequence: Synthetic oligonucleotide
  Description of Combined DNA/RNA Molecule: Synthetic oligonucleotide
agcauuuguuuuagcauuaccuaat

SEQ ID NO: 4745 - DNA, 25 bp, Artificial Sequence
  Description of Artificial Sequence: Synthetic oligonucleotide
  Description of Combined DNA/RNA Molecule: Synthetic oligonucleotide
gcauuuguuuuagcauuaccuaatt

SEQ ID NO: 4746 - DNA, 25 bp, Artificial Sequence
  Description of Artificial Sequence: Synthetic oligonucleotide
  Description of Combined DNA/RNA Molecule: Synthetic oligonucleotide
cauuuguuuuagcauuaccuaautt

SEQ ID NO: 4747 - DNA, 25 bp, Artificial Sequence
  Description of Artificial Sequence: Synthetic oligonucleotide
  Description of Combined DNA/RNA Molecule: Synthetic oligonucleotide
auuuguuuuagcauuaccuaauutt

SEQ ID NO: 4748 - DNA, 25 bp, Artificial Sequence
  Description of Artificial Sequence: Synthetic oligonucleotide
  Description of Combined DNA/RNA Molecule: Synthetic oligonucleotide
uuuguuuuagcauuaccuaauuutt

SEQ ID NO: 4749 - DNA, 25 bp, Artificial Sequence
  Description of Artificial Sequence: Synthetic oligonucleotide
  Description of Combined DNA/RNA Molecule: Synthetic oligonucleotide
cuuauuuuaaaaugacaguggaagt

SEQ ID NO: 4750 - DNA, 25 bp, Artificial Sequence
  Description of Artificial Sequence: Synthetic oligonucleotide
  Description of Combined DNA/RNA Molecule: Synthetic oligonucleotide
uauuuuaaaaugacaguggaagutt

SEQ ID NO: 4751 - DNA, 25 bp, Artificial Sequence
  Description of Artificial Sequence: Synthetic oligonucleotide
  Description of Combined DNA/RNA Molecule: Synthetic oligonucleotide
ucuaagugccaguauucccagagtt

SEQ ID NO: 4752 - DNA, 25 bp, Artificial Sequence
  Description of Artificial Sequence: Synthetic oligonucleotide
  Description of Combined DNA/RNA Molecule: Synthetic oligonucleotide
caaauuaaugaagcuuuugaaucat

SEQ ID NO: 4753 - DNA, 25 bp, Artificial Sequence
  Description of Artificial Sequence: Synthetic oligonucleotide
  Description of Combined DNA/RNA Molecule: Synthetic oligonucleotide
aaauuaaugaagcuuuugaaucatc

SEQ ID NO: 4754 - DNA, 25 bp, Artificial Sequence
  Description of Artificial Sequence: Synthetic oligonucleotide
  Description of Combined DNA/RNA Molecule: Synthetic oligonucleotide
uguguuuuaucuagucacauaaatg

SEQ ID NO: 4755 - RNA, 25 nt, Artificial Sequence
  Description of Artificial Sequence: Synthetic oligonucleotide
guguuuuaucuagucacauaaaugg

SEQ ID NO: 4756 - DNA, 25 bp, Artificial Sequence
  Description of Artificial Sequence: Synthetic oligonucleotide
  Description of Combined DNA/RNA Molecule: Synthetic oligonucleotide
uuuuaucuagucacauaaauggatt

SEQ ID NO: 4757 - RNA, 25 nt, Artificial Sequence
  Description of Artificial Sequence: Synthetic oligonucleotide
uaaauggauuaauuacuaauuucag

SEQ ID NO: 4758 - DNA, 25 bp, Artificial Sequence
  Description of Artificial Sequence: Synthetic oligonucleotide
  Description of Combined DNA/RNA Molecule: Synthetic oligonucleotide
aaauggauuaauuacuaauuucagt

SEQ ID NO: 4759 - RNA, 25 nt, Artificial Sequence
  Description of Artificial Sequence: Synthetic oligonucleotide
auugguuuuuacugaaacauugagg

SEQ ID NO: 4760 - DNA, 25 bp, Artificial Sequence
  Description of Artificial Sequence: Synthetic oligonucleotide
  Description of Combined DNA/RNA Molecule: Synthetic oligonucleotide
cauuuccuuuucacauuagauaaat

SEQ ID NO: 4761 - DNA, 25 bp, Artificial Sequence
  Description of Artificial Sequence: Synthetic oligonucleotide
  Description of Combined DNA/RNA Molecule: Synthetic oligonucleotide
cuuuucacauuagauaaauuacuat

SEQ ID NO: 4762 - DNA, 25 bp, Artificial Sequence
  Description of Artificial Sequence: Synthetic oligonucleotide
  Description of Combined DNA/RNA Molecule: Synthetic oligonucleotide
cauuagauaaauuacuauaaagact

SEQ ID NO: 4763 - DNA, 25 bp, Artificial Sequence
  Description of Artificial Sequence: Synthetic oligonucleotide
  Description of Combined DNA/RNA Molecule: Synthetic oligonucleotide
auuagauaaauuacuauaaagactc

SEQ ID NO: 4764 - RNA, 25 nt, Artificial Sequence
  Description of Artificial Sequence: Synthetic oligonucleotide
uuagauaaauuacuauaaagacucc

SEQ ID NO: 4765 - RNA, 25 nt, Artificial Sequence
  Description of Artificial Sequence: Synthetic oligonucleotide
uaaggcagacccaguaugaaauggg

SEQ ID NO: 4766 - RNA, 25 nt, Artificial Sequence
  Description of Artificial Sequence: Synthetic oligonucleotide
aaggcagacccaguaugaaaugggg

SEQ ID NO: 4767 - RNA, 25 nt, Artificial Sequence
  Description of Artificial Sequence: Synthetic oligonucleotide
aggcagacccaguaugaaaugggga

SEQ ID NO: 4768 - DNA, 25 bp, Artificial Sequence
  Description of Artificial Sequence: Synthetic oligonucleotide
  Description of Combined DNA/RNA Molecule: Synthetic oligonucleotide
ggcagacccaguaugaaauggggat

SEQ ID NO: 4769 - RNA, 25 nt, Artificial Sequence
  Description of Artificial Sequence: Synthetic oligonucleotide
uaugaaauggggauuauuauagcaa

SEQ ID NO: 4770 - RNA, 25 nt, Artificial Sequence
  Description of Artificial Sequence: Synthetic oligonucleotide
gggauuauuauagcaaccauuuugg

SEQ ID NO: 4771 - DNA, 25 bp, Artificial Sequence
  Description of Artificial Sequence: Synthetic oligonucleotide
  Description of Combined DNA/RNA Molecule: Synthetic oligonucleotide
gggcuauauuuacaugcuacuaaat

SEQ ID NO: 4772 - DNA, 25 bp, Artificial Sequence
  Description of Artificial Sequence: Synthetic oligonucleotide
  Description of Combined DNA/RNA Molecule: Synthetic oligonucleotide
ggcuauauuuacaugcuacuaaatt

SEQ ID NO: 4773 - DNA, 25 bp, Artificial Sequence
  Description of Artificial Sequence: Synthetic oligonucleotide
  Description of Combined DNA/RNA Molecule: Synthetic oligonucleotide
gcuauauuuacaugcuacuaaautt

SEQ ID NO: 4774 - DNA, 25 bp, Artificial Sequence
  Description of Artificial Sequence: Synthetic oligonucleotide
  Description of Combined DNA/RNA Molecule: Synthetic oligonucleotide
cuauauuuacaugcuacuaaauutt

SEQ ID NO: 4775 - DNA, 25 bp, Artificial Sequence
  Description of Artificial Sequence: Synthetic oligonucleotide
  Description of Combined DNA/RNA Molecule: Synthetic oligonucleotide
uauauuuacaugcuacuaaauuutt

SEQ ID NO: 4776 - DNA, 25 bp, Artificial Sequence
  Description of Artificial Sequence: Synthetic oligonucleotide
  Description of Combined DNA/RNA Molecule: Synthetic oligonucleotide
auauuuacaugcuacuaaauuuuta

SEQ ID NO: 4777 - DNA, 25 bp, Artificial Sequence
  Description of Artificial Sequence: Synthetic oligonucleotide
  Description of Combined DNA/RNA Molecule: Synthetic oligonucleotide
uauuuacaugcuacuaaauuuuuat

SEQ ID NO: 4778 - DNA, 25 bp, Artificial Sequence
  Description of Artificial Sequence: Synthetic oligonucleotide
  Description of Combined DNA/RNA Molecule: Synthetic oligonucleotide
auuuacaugcuacuaaauuuuuata

SEQ ID NO: 4779 - RNA, 25 nt, Artificial Sequence
  Description of Artificial Sequence: Synthetic oligonucleotide
uuuacaugcuacuaaauuuuuauaa

SEQ ID NO: 4780 - DNA, 25 bp, Artificial Sequence
  Description of Artificial Sequence: Synthetic oligonucleotide
  Description of Combined DNA/RNA Molecule: Synthetic oligonucleotide
uuacaugcuacuaaauuuuuauaat

SEQ ID NO: 4781 - DNA, 25 bp, Artificial Sequence
  Description of Artificial Sequence: Synthetic oligonucleotide
  Description of Combined DNA/RNA Molecule: Synthetic oligonucleotide
uacaugcuacuaaauuuuuauaata

SEQ ID NO: 4782 - DNA, 25 bp, Artificial Sequence
  Description of Artificial Sequence: Synthetic oligonucleotide
  Description of Combined DNA/RNA Molecule: Synthetic oligonucleotide
cuuucauaguauaacuuuaaauctt

SEQ ID NO: 4783 - DNA, 25 bp, Artificial Sequence
  Description of Artificial Sequence: Synthetic oligonucleotide
  Description of Combined DNA/RNA Molecule: Synthetic oligonucleotide
auaguauaacuuuaaaucuuuuctt

SEQ ID NO: 4784 - DNA, 25 bp, Artificial Sequence
  Description of Artificial Sequence: Synthetic oligonucleotide
  Description of Combined DNA/RNA Molecule: Synthetic oligonucleotide
uaguauaacuuuaaaucuuuucutc

SEQ ID NO: 4785 - DNA, 25 bp, Artificial Sequence
  Description of Artificial Sequence: Synthetic oligonucleotide
  Description of Combined DNA/RNA Molecule: Synthetic oligonucleotide
uaaaucuuuucuucaacuugaguct

SEQ ID NO: 4786 - DNA, 25 bp, Artificial Sequence
  Description of Artificial Sequence: Synthetic oligonucleotide
  Description of Combined DNA/RNA Molecule: Synthetic oligonucleotide
aaaucuuuucuucaacuugaguctt

SEQ ID NO: 4787 - RNA, 25 nt, Artificial Sequence
  Description of Artificial Sequence: Synthetic oligonucleotide
cuugagucuuugaagauaguuuuaa

SEQ ID NO: 4788 - DNA, 25 bp, Artificial Sequence
  Description of Artificial Sequence: Synthetic oligonucleotide
  Description of Combined DNA/RNA Molecule: Synthetic oligonucleotide
ugagucuuugaagauaguuuuaatt

SEQ ID NO: 4789 - DNA, 25 bp, Artificial Sequence
  Description of Artificial Sequence: Synthetic oligonucleotide
  Description of Combined DNA/RNA Molecule: Synthetic oligonucleotide
gagucuuugaagauaguuuuaautc

SEQ ID NO: 4790 - RNA, 25 nt, Artificial Sequence
  Description of Artificial Sequence: Synthetic oligonucleotide
gauaguuuuaauucugcuugugaca

SEQ ID NO: 4791 - DNA, 25 bp, Artificial Sequence
  Description of Artificial Sequence: Synthetic oligonucleotide
  Description of Combined DNA/RNA Molecule: Synthetic oligonucleotide
auaguuuuaauucugcuugugacat

SEQ ID NO: 4792 - DNA, 25 bp, Artificial Sequence
  Description of Artificial Sequence: Synthetic oligonucleotide
  Description of Combined DNA/RNA Molecule: Synthetic oligonucleotide
uaguuuuaauucugcuugugacatt

SEQ ID NO: 4793 - RNA, 25 nt, Artificial Sequence
  Description of Artificial Sequence: Synthetic oligonucleotide
cuugugacauuaaaagauuauuugg

SEQ ID NO: 4794 - DNA, 25 bp, Artificial Sequence
  Description of Artificial Sequence: Synthetic oligonucleotide
  Description of Combined DNA/RNA Molecule: Synthetic oligonucleotide
uauuaacucaaaaguugagauuutg

SEQ ID NO: 4795 - DNA, 25 bp, Artificial Sequence
  Description of Artificial Sequence: Synthetic oligonucleotide
  Description of Combined DNA/RNA Molecule: Synthetic oligonucleotide
ugugccaagacauuaauuuuuuutt

SEQ ID NO: 4796 - RNA, 25 nt, Artificial Sequence
  Description of Artificial Sequence: Synthetic oligonucleotide
ugguuaaauuaacauugcauaaaca

SEQ ID NO: 4797 - RNA, 25 nt, Artificial Sequence
  Description of Artificial Sequence: Synthetic oligonucleotide
gguuaaauuaacauugcauaaacac

SEQ ID NO: 4798 - DNA, 25 bp, Artificial Sequence
  Description of Artificial Sequence: Synthetic oligonucleotide
  Description of Combined DNA/RNA Molecule: Synthetic oligonucleotide
guuaaauuaacauugcauaaacact

SEQ ID NO: 4799 - DNA, 25 bp, Artificial Sequence
  Description of Artificial Sequence: Synthetic oligonucleotide
  Description of Combined DNA/RNA Molecule: Synthetic oligonucleotide
auugcauaaacacuuuucaaguctg

SEQ ID NO: 4800 - RNA, 25 nt, Artificial Sequence
  Description of Artificial Sequence: Synthetic oligonucleotide
aagucugauccauauuuaauaaugc

SEQ ID NO: 4801 - DNA, 25 bp, Artificial Sequence
  Description of Artificial Sequence: Synthetic oligonucleotide
  Description of Combined DNA/RNA Molecule: Synthetic oligonucleotide
uaaaauaaaugaagugagauggcat

SEQ ID NO: 4802 - DNA, 25 bp, Artificial Sequence
  Description of Artificial Sequence: Synthetic oligonucleotide
  Description of Combined DNA/RNA Molecule: Synthetic oligonucleotide
aaaauaaaugaagugagauggcatg

SEQ ID NO: 4803 - DNA, 25 bp, Artificial Sequence
  Description of Artificial Sequence: Synthetic oligonucleotide
  Description of Combined DNA/RNA Molecule: Synthetic oligonucleotide
aagcucagcacaaucuguaaauutt

SEQ ID NO: 4804 - DNA, 25 bp, Artificial Sequence
  Description of Artificial Sequence: Synthetic oligonucleotide
  Description of Combined DNA/RNA Molecule: Synthetic oligonucleotide
agcucagcacaaucuguaaauuutt

SEQ ID NO: 4805 - DNA, 25 bp, Artificial Sequence
  Description of Artificial Sequence: Synthetic oligonucleotide
  Description of Combined DNA/RNA Molecule: Synthetic oligonucleotide
auaacugugauucuuuuaggacaat

SEQ ID NO: 4806 - DNA, 25 bp, Artificial Sequence
  Description of Artificial Sequence: Synthetic oligonucleotide
  Description of Combined DNA/RNA Molecule: Synthetic oligonucleotide
ugugauucuuuuaggacaauuactg

SEQ ID NO: 4807 - DNA, 25 bp, Artificial Sequence
  Description of Artificial Sequence: Synthetic oligonucleotide
  Description of Combined DNA/RNA Molecule: Synthetic oligonucleotide
gugauucuuuuaggacaauuacugt

SEQ ID NO: 4808 - RNA, 25 nt, Artificial Sequence
  Description of Artificial Sequence: Synthetic oligonucleotide
uguaugucagauauucauauugacc

SEQ ID NO: 4809 - RNA, 25 nt, Artificial Sequence
  Description of Artificial Sequence: Synthetic oligonucleotide
guaugucagauauucauauugaccc

SEQ ID NO: 4810 - DNA, 25 bp, Artificial Sequence
  Description of Artificial Sequence: Synthetic oligonucleotide
  Description of Combined DNA/RNA Molecule: Synthetic oligonucleotide
aauguguaauauuccaguuuucuct

SEQ ID NO: 4811 - RNA, 25 nt, Artificial Sequence
  Description of Artificial Sequence: Synthetic oligonucleotide
cacugcauaggaauuuagaaccuaa

SEQ ID NO: 4812 - DNA, 25 bp, Artificial Sequence
  Description of Artificial Sequence: Synthetic oligonucleotide
  Description of Combined DNA/RNA Molecule: Synthetic oligonucleotide
caccauugcacaauuuuguccuaat

SEQ ID NO: 4813 - DNA, 25 bp, Artificial Sequence
  Description of Artificial Sequence: Synthetic oligonucleotide
  Description of Combined DNA/RNA Molecule: Synthetic oligonucleotide
accauugcacaauuuuguccuaata

SEQ ID NO: 4814 - DNA, 25 bp, Artificial Sequence
  Description of Artificial Sequence: Synthetic oligonucleotide
  Description of Combined DNA/RNA Molecule: Synthetic oligonucleotide
ccauugcacaauuuuguccuaauat

SEQ ID NO: 4815 - DNA, 25 bp, Artificial Sequence
  Description of Artificial Sequence: Synthetic oligonucleotide
  Description of Combined DNA/RNA Molecule: Synthetic oligonucleotide
cauugcacaauuuuguccuaauata

SEQ ID NO: 4816 - DNA, 25 bp, Artificial Sequence
  Description of Artificial Sequence: Synthetic oligonucleotide
  Description of Combined DNA/RNA Molecule: Synthetic oligonucleotide
auugcacaauuuuguccuaauauat

SEQ ID NO: 4817 - DNA, 25 bp, Artificial Sequence
  Description of Artificial Sequence: Synthetic oligonucleotide
  Description of Combined DNA/RNA Molecule: Synthetic oligonucleotide
uugcacaauuuuguccuaauauata

SEQ ID NO: 4818 - RNA, 25 nt, Artificial Sequence
  Description of Artificial Sequence: Synthetic oligonucleotide
uagcaugaauucugcauugagaaac

SEQ ID NO: 4819 - DNA, 25 bp, Artificial Sequence
  Description of Artificial Sequence: Synthetic oligonucleotide
  Description of Combined DNA/RNA Molecule: Synthetic oligonucleotide
agcaugaauucugcauugagaaact

SEQ ID NO: 4820 - DNA, 25 bp, Artificial Sequence
  Description of Artificial Sequence: Synthetic oligonucleotide
  Description of Combined DNA/RNA Molecule: Synthetic oligonucleotide
uuugaagugccuguuugggauaatg

SEQ ID NO: 4821 - RNA, 25 nt, Artificial Sequence
  Description of Artificial Sequence: Synthetic oligonucleotide
uugaagugccuguuugggauaauga

SEQ ID NO: 4822 - DNA, 25 bp, Artificial Sequence
  Description of Artificial Sequence: Synthetic oligonucleotide
  Description of Combined DNA/RNA Molecule: Synthetic oligonucleotide
ugaagugccuguuugggauaaugat

SEQ ID NO: 4823 - DNA, 25 bp, Artificial Sequence
  Description of Artificial Sequence: Synthetic oligonucleotide
  Description of Combined DNA/RNA Molecule: Synthetic oligonucleotide
uuugagugccaauuucuuacuagta

SEQ ID NO: 4824 - RNA, 25 nt, Artificial Sequence
  Description of Artificial Sequence: Synthetic oligonucleotide
uugagugccaauuucuuacuaguac

SEQ ID NO: 4825 - DNA, 25 bp, Artificial Sequence
  Description of Artificial Sequence: Synthetic oligonucleotide
  Description of Combined DNA/RNA Molecule: Synthetic oligonucleotide
ugagugccaauuucuuacuaguact

SEQ ID NO: 4826 - DNA, 25 bp, Artificial Sequence
  Description of Artificial Sequence: Synthetic oligonucleotide
  Description of Combined DNA/RNA Molecule: Synthetic oligonucleotide
gagugccaauuucuuacuaguacta

SEQ ID NO: 4827 - DNA, 25 bp, Artificial Sequence
  Description of Artificial Sequence: Synthetic oligonucleotide
  Description of Combined DNA/RNA Molecule: Synthetic oligonucleotide
agugccaauuucuuacuaguacuat

SEQ ID NO: 4828 - DNA, 25 bp, Artificial Sequence
  Description of Artificial Sequence: Synthetic oligonucleotide
  Description of Combined DNA/RNA Molecule: Synthetic oligonucleotide
gugccaauuucuuacuaguacuatt

SEQ ID NO: 4829 - RNA, 25 nt, Artificial Sequence
  Description of Artificial Sequence: Synthetic oligonucleotide
auguauuuuaacuauuuuuguauag

SEQ ID NO: 4830 - DNA, 25 bp, Artificial Sequence
  Description of Artificial Sequence: Synthetic oligonucleotide
  Description of Combined DNA/RNA Molecule: Synthetic oligonucleotide
uguauuuuaacuauuuuuguauagt

SEQ ID NO: 4831 - RNA, 25 nt, Artificial Sequence
  Description of Artificial Sequence: Synthetic oligonucleotide
acuauuuuuguauaguguaaacuga

SEQ ID NO: 4832 - RNA, 25 nt, Artificial Sequence
  Description of Artificial Sequence: Synthetic oligonucleotide
cuauuuuuguauaguguaaacugaa

SEQ ID NO: 4833 - RNA, 25 nt, Artificial Sequence
  Description of Artificial Sequence: Synthetic oligonucleotide
uauuuuuguauaguguaaacugaaa

SEQ ID NO: 4834 - RNA, 25 nt, Artificial Sequence
  Description of Artificial Sequence: Synthetic oligonucleotide
auuuuuguauaguguaaacugaaac

SEQ ID NO: 4835 - RNA, 25 nt, Artificial Sequence
  Description of Artificial Sequence: Synthetic oligonucleotide
uuuuuguauaguguaaacugaaaca

SEQ ID NO: 4836 - DNA, 25 bp, Artificial Sequence
  Description of Artificial Sequence: Synthetic oligonucleotide
  Description of Combined DNA/RNA Molecule: Synthetic oligonucleotide
uuuuguauaguguaaacugaaacat

SEQ ID NO: 4837 - RNA, 25 nt, Artificial Sequence
  Description of Artificial Sequence: Synthetic oligonucleotide
aacaugcacauuuuguacauugugc

SEQ ID NO: 4838 - DNA, 25 bp, Artificial Sequence
  Description of Artificial Sequence: Synthetic oligonucleotide
  Description of Combined DNA/RNA Molecule: Synthetic oligonucleotide
acaugcacauuuuguacauugugct

SEQ ID NO: 4839 - DNA, 25 bp, Artificial Sequence
  Description of Artificial Sequence: Synthetic oligonucleotide
  Description of Combined DNA/RNA Molecule: Synthetic oligonucleotide
ugcacauuuuguacauugugcuutc

SEQ ID NO: 4840 - DNA, 25 bp, Artificial Sequence
  Description of Artificial Sequence: Synthetic oligonucleotide
  Description of Combined DNA/RNA Molecule: Synthetic oligonucleotide
gcacauuuuguacauugugcuuuct

SEQ ID NO: 4841 - DNA, 25 bp, Artificial Sequence
  Description of Artificial Sequence: Synthetic oligonucleotide
  Description of Combined DNA/RNA Molecule: Synthetic oligonucleotide
cacauuuuguacauugugcuuuctt

SEQ ID NO: 4842 - DNA, 25 bp, Artificial Sequence
  Description of Artificial Sequence: Synthetic oligonucleotide
  Description of Combined DNA/RNA Molecule: Synthetic oligonucleotide
acauuuuguacauugugcuuucutt

SEQ ID NO: 4843 - DNA, 25 bp, Artificial Sequence
  Description of Artificial Sequence: Synthetic oligonucleotide
  Description of Combined DNA/RNA Molecule: Synthetic oligonucleotide
cauuuuguacauugugcuuucuutt

SEQ ID NO: 4844 - DNA, 25 bp, Artificial Sequence
  Description of Artificial Sequence: Synthetic oligonucleotide
  Description of Combined DNA/RNA Molecule: Synthetic oligonucleotide
auuuuguacauugugcuuucuuutg

SEQ ID NO: 4845 - DNA, 25 bp, Artificial Sequence
  Description of Artificial Sequence: Synthetic oligonucleotide
  Description of Combined DNA/RNA Molecule: Synthetic oligonucleotide
uuuuguacauugugcuuucuuuugt

SEQ ID NO: 4846 - DNA, 25 bp, Artificial Sequence
  Description of Artificial Sequence: Synthetic oligonucleotide
  Description of Combined DNA/RNA Molecule: Synthetic oligonucleotide
ugggacauaugcagugugauccagt

SEQ ID NO: 4847 - DNA, 25 bp, Artificial Sequence
  Description of Artificial Sequence: Synthetic oligonucleotide
  Description of Combined DNA/RNA Molecule: Synthetic oligonucleotide
gggacauaugcagugugauccagtt

SEQ ID NO: 4848 - DNA, 25 bp, Artificial Sequence
  Description of Artificial Sequence: Synthetic oligonucleotide
  Description of Combined DNA/RNA Molecule: Synthetic oligonucleotide
ggacauaugcagugugauccagutg

SEQ ID NO: 4849 - DNA, 25 bp, Artificial Sequence
  Description of Artificial Sequence: Synthetic oligonucleotide
  Description of Combined DNA/RNA Molecule: Synthetic oligonucleotide
gacauaugcagugugauccaguugt

SEQ ID NO: 4850 - DNA, 25 bp, Artificial Sequence
  Description of Artificial Sequence: Synthetic oligonucleotide
  Description of Combined DNA/RNA Molecule: Synthetic oligonucleotide
acauaugcagugugauccaguugtt

SEQ ID NO: 4851 - DNA, 25 bp, Artificial Sequence
  Description of Artificial Sequence: Synthetic oligonucleotide
  Description of Combined DNA/RNA Molecule: Synthetic oligonucleotide
cauaugcagugugauccaguugutt

SEQ ID NO: 4852 - DNA, 25 bp, Artificial Sequence
  Description of Artificial Sequence: Synthetic oligonucleotide
  Description of Combined DNA/RNA Molecule: Synthetic oligonucleotide
auaugcagugugauccaguuguutt

SEQ ID NO: 4853 - DNA, 25 bp, Artificial Sequence
  Description of Artificial Sequence: Synthetic oligonucleotide
  Description of Combined DNA/RNA Molecule: Synthetic oligonucleotide
uaugcagugugauccaguuguuutc

SEQ ID NO: 4854 - RNA, 25 nt, Artificial Sequence
  Description of Artificial Sequence: Synthetic oligonucleotide
augcagugugauccaguuguuuucc

SEQ ID NO: 4855 - RNA, 25 nt, Artificial Sequence
  Description of Artificial Sequence: Synthetic oligonucleotide
agugugauccaguuguuuuccauca

SEQ ID NO: 4856 - DNA, 25 bp, Artificial Sequence
  Description of Artificial Sequence: Synthetic oligonucleotide
  Description of Combined DNA/RNA Molecule: Synthetic oligonucleotide
gugugauccaguuguuuuccaucat

SEQ ID NO: 4857 - DNA, 25 bp, Artificial Sequence
  Description of Artificial Sequence: Synthetic oligonucleotide
  Description of Combined DNA/RNA Molecule: Synthetic oligonucleotide
ugugauccaguuguuuuccaucatt

SEQ ID NO: 4858 - DNA, 25 bp, Artificial Sequence
  Description of Artificial Sequence: Synthetic oligonucleotide
  Description of Combined DNA/RNA Molecule: Synthetic oligonucleotide
gugauccaguuguuuuccaucautt

SEQ ID NO: 4859 - DNA, 25 bp, Artificial Sequence
  Description of Artificial Sequence: Synthetic oligonucleotide
  Description of Combined DNA/RNA Molecule: Synthetic oligonucleotide
ugauccaguuguuuuccaucauutg

SEQ ID NO: 4860 - RNA, 25 nt, Artificial Sequence
  Description of Artificial Sequence: Synthetic oligonucleotide
gauccaguuguuuuccaucauuugg

SEQ ID NO: 4861 - DNA, 25 bp, Artificial Sequence
  Description of Artificial Sequence: Synthetic oligonucleotide
  Description of Combined DNA/RNA Molecule: Synthetic oligonucleotide
uuugguugcgcugaccuaggaaugt

SEQ ID NO: 4862 - DNA, 25 bp, Artificial Sequence
  Description of Artificial Sequence: Synthetic oligonucleotide
  Description of Combined DNA/RNA Molecule: Synthetic oligonucleotide
uugguugcgcugaccuaggaaugtt

SEQ ID NO: 4863 - DNA, 25 bp, Artificial Sequence
  Description of Artificial Sequence: Synthetic oligonucleotide
  Description of Combined DNA/RNA Molecule: Synthetic oligonucleotide
ggaauguuggucauaucaaacauta

SEQ ID NO: 4864 - RNA, 25 nt, Artificial Sequence
  Description of Artificial Sequence: Synthetic oligonucleotide
gaauguuggucauaucaaacauuaa

SEQ ID NO: 4865 - RNA, 25 nt, Artificial Sequence
  Description of Artificial Sequence: Synthetic oligonucleotide
aauguuggucauaucaaacauuaaa

SEQ ID NO: 4866 - RNA, 25 nt, Artificial Sequence
  Description of Artificial Sequence: Synthetic oligonucleotide
auguuggucauaucaaacauuaaaa

SEQ ID NO: 4867 - RNA, 25 nt, Artificial Sequence
  Description of Artificial Sequence: Synthetic oligonucleotide
uguuggucauaucaaacauuaaaaa

SEQ ID NO: 4868 - DNA, 25 bp, Artificial Sequence
  Description of Artificial Sequence: Synthetic oligonucleotide
  Description of Combined DNA/RNA Molecule: Synthetic oligonucleotide
guuggucauaucaaacauuaaaaat

SEQ ID NO: 4869 - DNA, 25 bp, Artificial Sequence
  Description of Artificial Sequence: Synthetic oligonucleotide
  Description of Combined DNA/RNA Molecule: Synthetic oligonucleotide
uuggucauaucaaacauuaaaaatg

SEQ ID NO: 4870 - RNA, 25 nt, Artificial Sequence
  Description of Artificial Sequence: Synthetic oligonucleotide
uggucauaucaaacauuaaaaauga

SEQ ID NO: 4871 - RNA, 25 nt, Artificial Sequence
  Description of Artificial Sequence: Synthetic oligonucleotide
ggucauaucaaacauuaaaaaugac

SEQ ID NO: 4872 - RNA, 25 nt, Artificial Sequence
  Description of Artificial Sequence: Synthetic oligonucleotide
aaauuaacuuuuaaauguuuauagg

SEQ ID NO: 4873 - RNA, 25 nt, Artificial Sequence
  Description of Artificial Sequence: Synthetic oligonucleotide
aauuaacuuuuaaauguuuauagga

SEQ ID NO: 4874 - DNA, 25 bp, Artificial Sequence
  Description of Artificial Sequence: Synthetic oligonucleotide
  Description of Combined DNA/RNA Molecule: Synthetic oligonucleotide
aacuuuuaaauguuuauaggaguat

SEQ ID NO: 4875 - DNA, 25 bp, Artificial Sequence
  Description of Artificial Sequence: Synthetic oligonucleotide
  Description of Combined DNA/RNA Molecule: Synthetic oligonucleotide
acuuuuaaauguuuauaggaguatg

SEQ ID NO: 4876 - DNA, 25 bp, Artificial Sequence
  Description of Artificial Sequence: Synthetic oligonucleotide
  Description of Combined DNA/RNA Molecule: Synthetic oligonucleotide
cuuuuaaauguuuauaggaguaugt

SEQ ID NO: 4877 - DNA, 25 bp, Artificial Sequence
  Description of Artificial Sequence: Synthetic oligonucleotide
  Description of Combined DNA/RNA Molecule: Synthetic oligonucleotide
uuuuaaauguuuauaggaguaugtg

SEQ ID NO: 4878 - RNA, 25 nt, Artificial Sequence
  Description of Artificial Sequence: Synthetic oligonucleotide
uuuaaauguuuauaggaguaugugc

SEQ ID NO: 4879 - DNA, 25 bp, Artificial Sequence
  Description of Artificial Sequence: Synthetic oligonucleotide
  Description of Combined DNA/RNA Molecule: Synthetic oligonucleotide
uuaaauguuuauaggaguaugugct

SEQ ID NO: 4880 - RNA, 25 nt, Artificial Sequence
  Description of Artificial Sequence: Synthetic oligonucleotide
aaauuuguaauauuuuugucaugaa

SEQ ID NO: 4881 - RNA, 25 nt, Artificial Sequence
  Description of Artificial Sequence: Synthetic oligonucleotide
aauuuguaauauuuuugucaugaac

SEQ ID NO: 4882 - DNA, 25 bp, Artificial Sequence
  Description of Artificial Sequence: Synthetic oligonucleotide
  Description of Combined DNA/RNA Molecule: Synthetic oligonucleotide
auuuguaauauuuuugucaugaact

SEQ ID NO: 4883 - DNA, 25 bp, Artificial Sequence
  Description of Artificial Sequence: Synthetic oligonucleotide
  Description of Combined DNA/RNA Molecule: Synthetic oligonucleotide
uuuguaauauuuuugucaugaactg

SEQ ID NO: 4884 - DNA, 25 bp, Artificial Sequence
  Description of Artificial Sequence: Synthetic oligonucleotide
  Description of Combined DNA/RNA Molecule: Synthetic oligonucleotide
uuguaauauuuuugucaugaacugt

SEQ ID NO: 4885 - DNA, 25 bp, Artificial Sequence
  Description of Artificial Sequence: Synthetic oligonucleotide
  Description of Combined DNA/RNA Molecule: Synthetic oligonucleotide
uguaauauuuuugucaugaacugta

SEQ ID NO: 4886 - RNA, 25 nt, Artificial Sequence
  Description of Artificial Sequence: Synthetic oligonucleotide
guaauauuuuugucaugaacuguac

SEQ ID NO: 4887 - DNA, 25 bp, Artificial Sequence
  Description of Artificial Sequence: Synthetic oligonucleotide
  Description of Combined DNA/RNA Molecule: Synthetic oligonucleotide
uaauauuuuugucaugaacuguact

SEQ ID NO: 4888 - RNA, 25 nt, Artificial Sequence
  Description of Artificial Sequence: Synthetic oligonucleotide
auuguaauguaauaaaaauaguuac

SEQ ID NO: 4889 - RNA, 25 nt, Artificial Sequence
  Description of Artificial Sequence: Synthetic oligonucleotide
uuguaauguaauaaaaauaguuaca

SEQ ID NO: 4890 - RNA, 25 nt, Artificial Sequence
  Description of Artificial Sequence: Synthetic oligonucleotide
uguaauguaauaaaaauaguuacag

SEQ ID NO: 4891 - DNA, 25 bp, Artificial Sequence
  Description of Artificial Sequence: Synthetic oligonucleotide
  Description of Combined DNA/RNA Molecule: Synthetic oligonucleotide
guaauguaauaaaaauaguuacagt

SEQ ID NO: 4892 - DNA, 25 bp, Artificial Sequence
  Description of Artificial Sequence: Synthetic oligonucleotide
  Description of Combined DNA/RNA Molecule: Synthetic oligonucleotide
uaauguaauaaaaauaguuacagtg

SEQ ID NO: 4893 - DNA, 27 bp, Homo sapiens
gagaggcctgctgaaaatgactgaata

SEQ ID NO: 4894 - DNA, 27 bp, Homo sapiens
agaggcctgctgaaaatgactgaatat

SEQ ID NO: 4895 - DNA, 27 bp, Homo sapiens
gaggcctgctgaaaatgactgaatata

SEQ ID NO: 4896 - DNA, 27 bp, Homo sapiens
aggcctgctgaaaatgactgaatataa

SEQ ID NO: 4897 - DNA, 27 bp, Homo sapiens
tagttggagctggtggcgtaggcaaga

SEQ ID NO: 4898 - DNA, 27 bp, Homo sapiens
agttggagctggtggcgtaggcaagag

SEQ ID NO: 4899 - DNA, 27 bp, Homo sapiens
gttggagctggtggcgtaggcaagagt

SEQ ID NO: 4900 - DNA, 27 bp, Homo sapiens
ttggagctggtggcgtaggcaagagtg

SEQ ID NO: 4901 - DNA, 27 bp, Homo sapiens
tggagctggtggcgtaggcaagagtgc

SEQ ID NO: 4902 - DNA, 27 bp, Homo sapiens
ggagctggtggcgtaggcaagagtgcc

SEQ ID NO: 4903 - DNA, 27 bp, Homo sapiens
gagctggtggcgtaggcaagagtgcct

SEQ ID NO: 4904 - DNA, 27 bp, Homo sapiens
gatacagctaattcagaatcattttgt

SEQ ID NO: 4905 - DNA, 27 bp, Homo sapiens
agtaattgatggagaaacctgtctctt

SEQ ID NO: 4906 - DNA, 27 bp, Homo sapiens
gtaattgatggagaaacctgtctcttg

SEQ ID NO: 4907 - DNA, 27 bp, Homo sapiens
ttgatggagaaacctgtctcttggata

SEQ ID NO: 4908 - DNA, 27 bp, Homo sapiens
aacctgtctcttggatattctcgacac

SEQ ID NO: 4909 - DNA, 27 bp, Homo sapiens
cctgtctcttggatattctcgacacag

SEQ ID NO: 4910 - DNA, 27 bp, Homo sapiens
ctgtctcttggatattctcgacacagc

SEQ ID NO: 4911 - DNA, 27 bp, Homo sapiens
tgtctcttggatattctcgacacagca

SEQ ID NO: 4912 - DNA, 27 bp, Homo sapiens
gtctcttggatattctcgacacagcag

SEQ ID NO: 4913 - DNA, 27 bp, Homo sapiens
tctcttggatattctcgacacagcagg

SEQ ID NO: 4914 - DNA, 27 bp, Homo sapiens
ctcttggatattctcgacacagcaggt

SEQ ID NO: 4915 - DNA, 27 bp, Homo sapiens
tcttggatattctcgacacagcaggtc

SEQ ID NO: 4916 - DNA, 27 bp, Homo sapiens
cacagcaggtcaagaggagtacagtgc

SEQ ID NO: 4917 - DNA, 27 bp, Homo sapiens
acagcaggtcaagaggagtacagtgca

SEQ ID NO: 4918 - DNA, 27 bp, Homo sapiens
cagcaggtcaagaggagtacagtgcaa

SEQ ID NO: 4919 - DNA, 27 bp, Homo sapiens
agaggagtacagtgcaatgagggacca

SEQ ID NO: 4920 - DNA, 27 bp, Homo sapiens
gaggagtacagtgcaatgagggaccag

SEQ ID NO: 4921 - DNA, 27 bp, Homo sapiens
aggagtacagtgcaatgagggaccagt

SEQ ID NO: 4922 - DNA, 27 bp, Homo sapiens
ggagtacagtgcaatgagggaccagta

SEQ ID NO: 4923 - DNA, 27 bp, Homo sapiens
gagtacagtgcaatgagggaccagtac

SEQ ID NO: 4924 - DNA, 27 bp, Homo sapiens
agtacagtgcaatgagggaccagtaca

SEQ ID NO: 4925 - DNA, 27 bp, Homo sapiens
gtacagtgcaatgagggaccagtacat

SEQ ID NO: 4926 - DNA, 27 bp, Homo sapiens
tacagtgcaatgagggaccagtacatg

SEQ ID NO: 4927 - DNA, 27 bp, Homo sapiens
acagtgcaatgagggaccagtacatga

SEQ ID NO: 4928 - DNA, 27 bp, Homo sapiens
gtgtatttgccataaataatactaaat

SEQ ID NO: 4929 - DNA, 27 bp, Homo sapiens
tgtatttgccataaataatactaaatc

SEQ ID NO: 4930 - DNA, 27 bp, Homo sapiens
gtatttgccataaataatactaaatca

SEQ ID NO: 4931 - DNA, 27 bp, Homo sapiens
tatttgccataaataatactaaatcat

SEQ ID NO: 4932 - DNA, 27 bp, Homo sapiens
atttgccataaataatactaaatcatt

SEQ ID NO: 4933 - DNA, 27 bp, Homo sapiens
tttgccataaataatactaaatcattt

SEQ ID NO: 4934 - DNA, 27 bp, Homo sapiens
ttgccataaataatactaaatcatttg

SEQ ID NO: 4935 - DNA, 27 bp, Homo sapiens
taatactaaatcatttgaagatattca

SEQ ID NO: 4936 - DNA, 27 bp, Homo sapiens
aatactaaatcatttgaagatattcac

SEQ ID NO: 4937 - DNA, 27 bp, Homo sapiens
atactaaatcatttgaagatattcacc

SEQ ID NO: 4938 - DNA, 27 bp, Homo sapiens
tactaaatcatttgaagatattcacca

SEQ ID NO: 4939 - DNA, 27 bp, Homo sapiens
actaaatcatttgaagatattcaccat

SEQ ID NO: 4940 - DNA, 27 bp, Homo sapiens
ctaaatcatttgaagatattcaccatt

SEQ ID NO: 4941 - DNA, 27 bp, Homo sapiens
taaatcatttgaagatattcaccatta

SEQ ID NO: 4942 - DNA, 27 bp, Homo sapiens
aaatcatttgaagatattcaccattat

SEQ ID NO: 4943 - DNA, 27 bp, Homo sapiens
aatcatttgaagatattcaccattata

SEQ ID NO: 4944 - DNA, 27 bp, Homo sapiens
agatattcaccattatagagaacaaat

SEQ ID NO: 4945 - DNA, 27 bp, Homo sapiens
gatattcaccattatagagaacaaatt

SEQ ID NO: 4946 - DNA, 27 bp, Homo sapiens
atattcaccattatagagaacaaatta

SEQ ID NO: 4947 - DNA, 27 bp, Homo sapiens
tattcaccattatagagaacaaattaa

SEQ ID NO: 4948 - DNA, 27 bp, Homo sapiens
attcaccattatagagaacaaattaaa

SEQ ID NO: 4949 - DNA, 27 bp, Homo sapiens
ttcaccattatagagaacaaattaaaa

SEQ ID NO: 4950 - DNA, 27 bp, Homo sapiens
tcaccattatagagaacaaattaaaag

SEQ ID NO: 4951 - DNA, 27 bp, Homo sapiens
caccattatagagaacaaattaaaaga

SEQ ID NO: 4952 - DNA, 27 bp, Homo sapiens
accattatagagaacaaattaaaagag

SEQ ID NO: 4953 - DNA, 27 bp, Homo sapiens
acctatggtcctagtaggaaataaatg

SEQ ID NO: 4954 - DNA, 27 bp, Homo sapiens
aatgtgatttgccttctagaacagtag

SEQ ID NO: 4955 - DNA, 27 bp, Homo sapiens
atgtgatttgccttctagaacagtaga

SEQ ID NO: 4956 - DNA, 27 bp, Homo sapiens
gtgatttgccttctagaacagtagaca

SEQ ID NO: 4957 - DNA, 27 bp, Homo sapiens
aagttatggaattccttttattgaaac

SEQ ID NO: 4958 - DNA, 27 bp, Homo sapiens
agttatggaattccttttattgaaaca

SEQ ID NO: 4959 - DNA, 27 bp, Homo sapiens
gttatggaattccttttattgaaacat

SEQ ID NO: 4960 - DNA, 27 bp, Homo sapiens
atgatgccttctatacattagttcgag

SEQ ID NO: 4961 - DNA, 27 bp, Homo sapiens
tgatgccttctatacattagttcgaga

SEQ ID NO: 4962 - DNA, 27 bp, Homo sapiens
ttcgagaaattcgaaaacataaagaaa

SEQ ID NO: 4963 - DNA, 27 bp, Homo sapiens
tcgaaaacataaagaaaagatgagcaa

SEQ ID NO: 4964 - DNA, 27 bp, Homo sapiens
cgaaaacataaagaaaagatgagcaaa

SEQ ID NO: 4965 - DNA, 27 bp, Homo sapiens
gaaaacataaagaaaagatgagcaaag

SEQ ID NO: 4966 - DNA, 27 bp, Homo sapiens
aaaacataaagaaaagatgagcaaaga

SEQ ID NO: 4967 - DNA, 27 bp, Homo sapiens
aaacataaagaaaagatgagcaaagat

SEQ ID NO: 4968 - DNA, 27 bp, Homo sapiens
aacataaagaaaagatgagcaaagatg

SEQ ID NO: 4969 - DNA, 27 bp, Homo sapiens
acataaagaaaagatgagcaaagatgg

SEQ ID NO: 4970 - DNA, 27 bp, Homo sapiens
cataaagaaaagatgagcaaagatggt

SEQ ID NO: 4971 - DNA, 27 bp, Homo sapiens
ataaagaaaagatgagcaaagatggta

SEQ ID NO: 4972 - DNA, 27 bp, Homo sapiens
acaagtggtaatttttgtacattacac

SEQ ID NO: 4973 - DNA, 27 bp, Homo sapiens
caagtggtaatttttgtacattacact

SEQ ID NO: 4974 - DNA, 27 bp, Homo sapiens
ttttgtacattacactaaattattagc

SEQ ID NO: 4975 - DNA, 27 bp, Homo sapiens
tttgtacattacactaaattattagca

SEQ ID NO: 4976 - DNA, 27 bp, Homo sapiens
ttgtacattacactaaattattagcat

SEQ ID NO: 4977 - DNA, 27 bp, Homo sapiens
tgtacattacactaaattattagcatt

SEQ ID NO: 4978 - DNA, 27 bp, Homo sapiens
gtacattacactaaattattagcattt

SEQ ID NO: 4979 - DNA, 27 bp, Homo sapiens
tacattacactaaattattagcatttg

SEQ ID NO: 4980 - DNA, 27 bp, Homo sapiens
acattacactaaattattagcatttgt

SEQ ID NO: 4981 - DNA, 27 bp, Homo sapiens
cattacactaaattattagcatttgtt

SEQ ID NO: 4982 - DNA, 27 bp, Homo sapiens
attacactaaattattagcatttgttt

SEQ ID NO: 4983 - DNA, 27 bp, Homo sapiens
attattagcatttgttttagcattacc

SEQ ID NO: 4984 - DNA, 27 bp, Homo sapiens
ttattagcatttgttttagcattacct

SEQ ID NO: 4985 - DNA, 27 bp, Homo sapiens
tattagcatttgttttagcattaccta

SEQ ID NO: 4986 - DNA, 27 bp, Homo sapiens
attagcatttgttttagcattacctaa

SEQ ID NO: 4987 - DNA, 27 bp, Homo sapiens
ttagcatttgttttagcattacctaat

SEQ ID NO: 4988 - DNA, 27 bp, Homo sapiens
tagcatttgttttagcattacctaatt

SEQ ID NO: 4989 - DNA, 27 bp, Homo sapiens
agcatttgttttagcattacctaattt

SEQ ID NO: 4990 - DNA, 27 bp, Homo sapiens
gcatttgttttagcattacctaatttt

SEQ ID NO: 4991 - DNA, 27 bp, Homo sapiens
catttgttttagcattacctaattttt

SEQ ID NO: 4992 - DNA, 27 bp, Homo sapiens
tgcttattttaaaatgacagtggaagt

SEQ ID NO: 4993 - DNA, 27 bp, Homo sapiens
cttattttaaaatgacagtggaagttt

SEQ ID NO: 4994 - DNA, 27 bp, Homo sapiens
cctctaagtgccagtattcccagagtt

SEQ ID NO: 4995 - DNA, 27 bp, Homo sapiens
aacaaattaatgaagcttttgaatcat

SEQ ID NO: 4996 - DNA, 27 bp, Homo sapiens
acaaattaatgaagcttttgaatcatc

SEQ ID NO: 4997 - DNA, 27 bp, Homo sapiens
tctgtgttttatctagtcacataaatg

SEQ ID NO: 4998 - DNA, 27 bp, Homo sapiens
ctgtgttttatctagtcacataaatgg

SEQ ID NO: 4999 - DNA, 27 bp, Homo sapiens
tgttttatctagtcacataaatggatt

SEQ ID NO: 5000 - DNA, 27 bp, Homo sapiens
cataaatggattaattactaatttcag

SEQ ID NO: 5001 - DNA, 27 bp, Homo sapiens
ataaatggattaattactaatttcagt

SEQ ID NO: 5002 - DNA, 27 bp, Homo sapiens
taattggtttttactgaaacattgagg

SEQ ID NO: 5003 - DNA, 27 bp, Homo sapiens
gccatttccttttcacattagataaat

SEQ ID NO: 5004 - DNA, 27 bp, Homo sapiens
tccttttcacattagataaattactat

SEQ ID NO: 5005 - DNA, 27 bp, Homo sapiens
cacattagataaattactataaagact

SEQ ID NO: 5006 - DNA, 27 bp, Homo sapiens
acattagataaattactataaagactc

SEQ ID NO: 5007 - DNA, 27 bp, Homo sapiens
cattagataaattactataaagactcc

SEQ ID NO: 5008 - DNA, 27 bp, Homo sapiens
gttaaggcagacccagtatgaaatggg

SEQ ID NO: 5009 - DNA, 27 bp, Homo sapiens
ttaaggcagacccagtatgaaatgggg

SEQ ID NO: 5010 - DNA, 27 bp, Homo sapiens
taaggcagacccagtatgaaatgggga

SEQ ID NO: 5011 - DNA, 27 bp, Homo sapiens
aaggcagacccagtatgaaatggggat

SEQ ID NO: 5012 - DNA, 27 bp, Homo sapiens
agtatgaaatggggattattatagcaa

SEQ ID NO: 5013 - DNA, 27 bp, Homo sapiens
tggggattattatagcaaccattttgg

SEQ ID NO: 5014 - DNA, 27 bp, Homo sapiens
tggggctatatttacatgctactaaat

SEQ ID NO: 5015 - DNA, 27 bp, Homo sapiens
ggggctatatttacatgctactaaatt

SEQ ID NO: 5016 - DNA, 27 bp, Homo sapiens
gggctatatttacatgctactaaattt

SEQ ID NO: 5017 - DNA, 27 bp, Homo sapiens
ggctatatttacatgctactaaatttt

SEQ ID NO: 5018 - DNA, 27 bp, Homo sapiens
gctatatttacatgctactaaattttt

SEQ ID NO: 5019 - DNA, 27 bp, Homo sapiens
ctatatttacatgctactaaattttta

SEQ ID NO: 5020 - DNA, 27 bp, Homo sapiens
tatatttacatgctactaaatttttat

SEQ ID NO: 5021 - DNA, 27 bp, Homo sapiens
atatttacatgctactaaatttttata

SEQ ID NO: 5022 - DNA, 27 bp, Homo sapiens
tatttacatgctactaaatttttataa

SEQ ID NO: 5023 - DNA, 27 bp, Homo sapiens
atttacatgctactaaatttttataat

SEQ ID NO: 5024 - DNA, 27 bp, Homo sapiens
tttacatgctactaaatttttataata

SEQ ID NO: 5025 - DNA, 27 bp, Homo sapiens
ctctttcatagtataactttaaatctt

SEQ ID NO: 5026 - DNA, 27 bp, Homo sapiens
tcatagtataactttaaatcttttctt

SEQ ID NO: 5027 - DNA, 27 bp, Homo sapiens
catagtataactttaaatcttttcttc

SEQ ID NO: 5028 - DNA, 27 bp, Homo sapiens
tttaaatcttttcttcaacttgagtct

SEQ ID NO: 5029 - DNA, 27 bp, Homo sapiens
ttaaatcttttcttcaacttgagtctt

SEQ ID NO: 5030 - DNA, 27 bp, Homo sapiens
aacttgagtctttgaagatagttttaa

SEQ ID NO: 5031 - DNA, 27 bp, Homo sapiens
cttgagtctttgaagatagttttaatt

SEQ ID NO: 5032 - DNA, 27 bp, Homo sapiens
ttgagtctttgaagatagttttaattc

SEQ ID NO: 5033 - DNA, 27 bp, Homo sapiens
aagatagttttaattctgcttgtgaca

SEQ ID NO: 5034 - DNA, 27 bp, Homo sapiens
agatagttttaattctgcttgtgacat

SEQ ID NO: 5035 - DNA, 27 bp, Homo sapiens
gatagttttaattctgcttgtgacatt

SEQ ID NO: 5036 - DNA, 27 bp, Homo sapiens
tgcttgtgacattaaaagattatttgg

SEQ ID NO: 5037 - DNA, 27 bp, Homo sapiens
aatattaactcaaaagttgagattttg

SEQ ID NO: 5038 - DNA, 27 bp, Homo sapiens
ggtgtgccaagacattaattttttttt

SEQ ID NO: 5039 - DNA, 27 bp, Homo sapiens
actggttaaattaacattgcataaaca

SEQ ID NO: 5040 - DNA, 27 bp, Homo sapiens
ctggttaaattaacattgcataaacac

SEQ ID NO: 5041 - DNA, 27 bp, Homo sapiens
tggttaaattaacattgcataaacact

SEQ ID NO: 5042 - DNA, 27 bp, Homo sapiens
acattgcataaacacttttcaagtctg

SEQ ID NO: 5043 - DNA, 27 bp, Homo sapiens
tcaagtctgatccatatttaataatgc

SEQ ID NO: 5044 - DNA, 27 bp, Homo sapiens
tttaaaataaatgaagtgagatggcat

SEQ ID NO: 5045 - DNA, 27 bp, Homo sapiens
ttaaaataaatgaagtgagatggcatg

SEQ ID NO: 5046 - DNA, 27 bp, Homo sapiens
tcaagctcagcacaatctgtaaatttt

SEQ ID NO: 5047 - DNA, 27 bp, Homo sapiens
caagctcagcacaatctgtaaattttt

SEQ ID NO: 5048 - DNA, 27 bp, Homo sapiens
gcataactgtgattcttttaggacaat

SEQ ID NO: 5049 - DNA, 27 bp, Homo sapiens
actgtgattcttttaggacaattactg

SEQ ID NO: 5050 - DNA, 27 bp, Homo sapiens
ctgtgattcttttaggacaattactgt

SEQ ID NO: 5051 - DNA, 27 bp, Homo sapiens
ggtgtatgtcagatattcatattgacc

SEQ ID NO: 5052 - DNA, 27 bp, Homo sapiens
gtgtatgtcagatattcatattgaccc

SEQ ID NO: 5053 - DNA, 27 bp, Homo sapiens
caaatgtgtaatattccagttttctct

SEQ ID NO: 5054 - DNA, 27 bp, Homo sapiens
cacactgcataggaatttagaacctaa

SEQ ID NO: 5055 - DNA, 27 bp, Homo sapiens
gtcaccattgcacaattttgtcctaat

SEQ ID NO: 5056 - DNA, 27 bp, Homo sapiens
tcaccattgcacaattttgtcctaata

SEQ ID NO: 5057 - DNA, 27 bp, Homo sapiens
caccattgcacaattttgtcctaatat

SEQ ID NO: 5058 - DNA, 27 bp, Homo sapiens
accattgcacaattttgtcctaatata

SEQ ID NO: 5059 - DNA, 27 bp, Homo sapiens
ccattgcacaattttgtcctaatatat

SEQ ID NO: 5060 - DNA, 27 bp, Homo sapiens
cattgcacaattttgtcctaatatata

SEQ ID NO: 5061 - DNA, 27 bp, Homo sapiens
gatagcatgaattctgcattgagaaac

SEQ ID NO: 5062 - DNA, 27 bp, Homo sapiens
atagcatgaattctgcattgagaaact

SEQ ID NO: 5063 - DNA, 27 bp, Homo sapiens
agtttgaagtgcctgtttgggataatg

SEQ ID NO: 5064 - DNA, 27 bp, Homo sapiens
gtttgaagtgcctgtttgggataatga

SEQ ID NO: 5065 - DNA, 27 bp, Homo sapiens
tttgaagtgcctgtttgggataatgat

SEQ ID NO: 5066 - DNA, 27 bp, Homo sapiens
cctttgagtgccaatttcttactagta

SEQ ID NO: 5067 - DNA, 27 bp, Homo sapiens
ctttgagtgccaatttcttactagtac

SEQ ID NO: 5068 - DNA, 27 bp, Homo sapiens
tttgagtgccaatttcttactagtact

SEQ ID NO: 5069 - DNA, 27 bp, Homo sapiens
ttgagtgccaatttcttactagtacta

SEQ ID NO: 5070 - DNA, 27 bp, Homo sapiens
tgagtgccaatttcttactagtactat

SEQ ID NO: 5071 - DNA, 27 bp, Homo sapiens
gagtgccaatttcttactagtactatt

SEQ ID NO: 5072 - DNA, 27 bp, Homo sapiens
gaatgtattttaactatttttgtatag

SEQ ID NO: 5073 - DNA, 27 bp, Homo sapiens
aatgtattttaactatttttgtatagt

SEQ ID NO: 5074 - DNA, 27 bp, Homo sapiens
taactatttttgtatagtgtaaactga

SEQ ID NO: 5075 - DNA, 27 bp, Homo sapiens
aactatttttgtatagtgtaaactgaa

SEQ ID NO: 5076 - DNA, 27 bp, Homo sapiens
actatttttgtatagtgtaaactgaaa

SEQ ID NO: 5077 - DNA, 27 bp, Homo sapiens
ctatttttgtatagtgtaaactgaaac

SEQ ID NO: 5078 - DNA, 27 bp, Homo sapiens
tatttttgtatagtgtaaactgaaaca

SEQ ID NO: 5079 - DNA, 27 bp, Homo sapiens
atttttgtatagtgtaaactgaaacat

SEQ ID NO: 5080 - DNA, 27 bp, Homo sapiens
gaaacatgcacattttgtacattgtgc

SEQ ID NO: 5081 - DNA, 27 bp, Homo sapiens
aaacatgcacattttgtacattgtgct

SEQ ID NO: 5082 - DNA, 27 bp, Homo sapiens
catgcacattttgtacattgtgctttc

SEQ ID NO: 5083 - DNA, 27 bp, Homo sapiens
atgcacattttgtacattgtgctttct

SEQ ID NO: 5084 - DNA, 27 bp, Homo sapiens
tgcacattttgtacattgtgctttctt

SEQ ID NO: 5085 - DNA, 27 bp, Homo sapiens
gcacattttgtacattgtgctttcttt

SEQ ID NO: 5086 - DNA, 27 bp, Homo sapiens
cacattttgtacattgtgctttctttt

SEQ ID NO: 5087 - DNA, 27 bp, Homo sapiens
acattttgtacattgtgctttcttttg

SEQ ID NO: 5088 - DNA, 27 bp, Homo sapiens
cattttgtacattgtgctttcttttgt

SEQ ID NO: 5089 - DNA, 27 bp, Homo sapiens
tgtgggacatatgcagtgtgatccagt

SEQ ID NO: 5090 - DNA, 27 bp, Homo sapiens
gtgggacatatgcagtgtgatccagtt

SEQ ID NO: 5091 - DNA, 27 bp, Homo sapiens
tgggacatatgcagtgtgatccagttg

SEQ ID NO: 5092 - DNA, 27 bp, Homo sapiens
gggacatatgcagtgtgatccagttgt

SEQ ID NO: 5093 - DNA, 27 bp, Homo sapiens
ggacatatgcagtgtgatccagttgtt

SEQ ID NO: 5094 - DNA, 27 bp, Homo sapiens
gacatatgcagtgtgatccagttgttt

SEQ ID NO: 5095 - DNA, 27 bp, Homo sapiens
acatatgcagtgtgatccagttgtttt

SEQ ID NO: 5096 - DNA, 27 bp, Homo sapiens
catatgcagtgtgatccagttgttttc

SEQ ID NO: 5097 - DNA, 27 bp, Homo sapiens
atatgcagtgtgatccagttgttttcc

SEQ ID NO: 5098 - DNA, 27 bp, Homo sapiens
gcagtgtgatccagttgttttccatca

SEQ ID NO: 5099 - DNA, 27 bp, Homo sapiens
cagtgtgatccagttgttttccatcat

SEQ ID NO: 5100 - DNA, 27 bp, Homo sapiens
agtgtgatccagttgttttccatcatt

SEQ ID NO: 5101 - DNA, 27 bp, Homo sapiens
gtgtgatccagttgttttccatcattt

SEQ ID NO: 5102 - DNA, 27 bp, Homo sapiens
tgtgatccagttgttttccatcatttg

SEQ ID NO: 5103 - DNA, 27 bp, Homo sapiens
gtgatccagttgttttccatcatttgg

SEQ ID NO: 5104 - DNA, 27 bp, Homo sapiens
catttggttgcgctgacctaggaatgt

SEQ ID NO: 5105 - DNA, 27 bp, Homo sapiens
atttggttgcgctgacctaggaatgtt

SEQ ID NO: 5106 - DNA, 27 bp, Homo sapiens
taggaatgttggtcatatcaaacatta

SEQ ID NO: 5107 - DNA, 27 bp, Homo sapiens
aggaatgttggtcatatcaaacattaa

SEQ ID NO: 5108 - DNA, 27 bp, Homo sapiens
ggaatgttggtcatatcaaacattaaa

SEQ ID NO: 5109 - DNA, 27 bp, Homo sapiens
gaatgttggtcatatcaaacattaaaa

SEQ ID NO: 5110 - DNA, 27 bp, Homo sapiens
aatgttggtcatatcaaacattaaaaa

SEQ ID NO: 5111 - DNA, 27 bp, Homo sapiens
atgttggtcatatcaaacattaaaaat

SEQ ID NO: 5112 - DNA, 27 bp, Homo sapiens
tgttggtcatatcaaacattaaaaatg

SEQ ID NO: 5113 - DNA, 27 bp, Homo sapiens
gttggtcatatcaaacattaaaaatga

SEQ ID NO: 5114 - DNA, 27 bp, Homo sapiens
ttggtcatatcaaacattaaaaatgac

SEQ ID NO: 5115 - DNA, 27 bp, Homo sapiens
tgaaattaacttttaaatgtttatagg

SEQ ID NO: 5116 - DNA, 27 bp, Homo sapiens
gaaattaacttttaaatgtttatagga

SEQ ID NO: 5117 - DNA, 27 bp, Homo sapiens
ttaacttttaaatgtttataggagtat

SEQ ID NO: 5118 - DNA, 27 bp, Homo sapiens
taacttttaaatgtttataggagtatg

SEQ ID NO: 5119 - DNA, 27 bp, Homo sapiens
aacttttaaatgtttataggagtatgt

SEQ ID NO: 5120 - DNA, 27 bp, Homo sapiens
acttttaaatgtttataggagtatgtg

SEQ ID NO: 5121 - DNA, 27 bp, Homo sapiens
cttttaaatgtttataggagtatgtgc

SEQ ID NO: 5122 - DNA, 27 bp, Homo sapiens
ttttaaatgtttataggagtatgtgct

SEQ ID NO: 5123 - DNA, 27 bp, Homo sapiens
taaaatttgtaatatttttgtcatgaa

SEQ ID NO: 5124 - DNA, 27 bp, Homo sapiens
aaaatttgtaatatttttgtcatgaac

SEQ ID NO: 5125 - DNA, 27 bp, Homo sapiens
aaatttgtaatatttttgtcatgaact

SEQ ID NO: 5126 - DNA, 27 bp, Homo sapiens
aatttgtaatatttttgtcatgaactg

SEQ ID NO: 5127 - DNA, 27 bp, Homo sapiens
atttgtaatatttttgtcatgaactgt

SEQ ID NO: 5128 - DNA, 27 bp, Homo sapiens
tttgtaatatttttgtcatgaactgta

SEQ ID NO: 5129 - DNA, 27 bp, Homo sapiens
ttgtaatatttttgtcatgaactgtac

SEQ ID NO: 5130 - DNA, 27 bp, Homo sapiens
tgtaatatttttgtcatgaactgtact

SEQ ID NO: 5131 - DNA, 27 bp, Homo sapiens
ttattgtaatgtaataaaaatagttac

SEQ ID NO: 5132 - DNA, 27 bp, Homo sapiens
tattgtaatgtaataaaaatagttaca

SEQ ID NO: 5133 - DNA, 27 bp, Homo sapiens
attgtaatgtaataaaaatagttacag

SEQ ID NO: 5134 - DNA, 27 bp, Homo sapiens
ttgtaatgtaataaaaatagttacagt

SEQ ID NO: 5135 - DNA, 27 bp, Homo sapiens
tgtaatgtaataaaaatagttacagtg

SEQ ID NO: 5136 - DNA, 25 bp, Artificial Sequence
  Description of Artificial Sequence: Synthetic oligonucleotide
  Description of Combined DNA/RNA Molecule: Synthetic oligonucleotide
guauuugccauaaauaauacucaat

SEQ ID NO: 5137 - DNA, 25 bp, Artificial Sequence
  Description of Artificial Sequence: Synthetic oligonucleotide
  Description of Combined DNA/RNA Molecule: Synthetic oligonucleotide
guauuugccauaaauaauacuacat

SEQ ID NO: 5138 - DNA, 25 bp, Artificial Sequence
  Description of Artificial Sequence: Synthetic oligonucleotide
  Description of Combined DNA/RNA Molecule: Synthetic oligonucleotide
guauuugccauaaauaauacuaact

SEQ ID NO: 5139 - RNA, 25 nt, Artificial Sequence
  Description of Artificial Sequence: Synthetic oligonucleotide
guauuugccauaaauaauacuaaag

SEQ ID NO: 5140 - RNA, 27 nt, Artificial Sequence
  Description of Artificial Sequence: Synthetic oligonucleotide
cuuuaguauuauuuauggcaaauacac

SEQ ID NO: 5141 - RNA, 27 nt, Artificial Sequence
  Description of Artificial Sequence: Synthetic oligonucleotide
acuuaguauuauuuauggcaaauacac

SEQ ID NO: 5142 - RNA, 27 nt, Artificial Sequence
  Description of Artificial Sequence: Synthetic oligonucleotide
auguaguauuauuuauggcaaauacac

SEQ ID NO: 5143 - RNA, 27 nt, Artificial Sequence
  Description of Artificial Sequence: Synthetic oligonucleotide
auugaguauuauuuauggcaaauacac

SEQ ID NO: 5144 - RNA, 25 nt, Artificial Sequence
  Description of Artificial Sequence: Synthetic oligonucleotide
guuggagcugguggcguaggcaaga

SEQ ID NO: 5145 - RNA, 25 nt, Artificial Sequence
  Description of Artificial Sequence: Synthetic oligonucleotide
guuggagcuguuggcguaggcaaga

SEQ ID NO: 5146 - RNA, 25 nt, Artificial Sequence
  Description of Artificial Sequence: Synthetic oligonucleotide
uauucucgacacagcaggucaagag

SEQ ID NO: 5147 - RNA, 25 nt, Artificial Sequence
  Description of Artificial Sequence: Synthetic oligonucleotide
uauucucgacacagcaggucaugag

SEQ ID NO: 5148 - RNA, 25 nt, Artificial Sequence
  Description of Artificial Sequence: Synthetic oligonucleotide
uucucgacacagcaggucaagagga

SEQ ID NO: 5149 - RNA, 25 nt, Artificial Sequence
  Description of Artificial Sequence: Synthetic oligonucleotide
uucucgacacagcaggucaugagga

SEQ ID NO: 5150 - RNA, 25 nt, Artificial Sequence
  Description of Artificial Sequence: Synthetic oligonucleotide
caggucaagaggaguacagugcaau

SEQ ID NO: 5151 - RNA, 25 nt, Artificial Sequence
  Description of Artificial Sequence: Synthetic oligonucleotide
caggucaugaggaguacagugcaau

SEQ ID NO: 5152 - RNA, 25 nt, Artificial Sequence
  Description of Artificial Sequence: Synthetic oligonucleotide
aagaggaguacagugcaaugaggga

SEQ ID NO: 5153 - RNA, 25 nt, Artificial Sequence
  Description of Artificial Sequence: Synthetic oligonucleotide
augaggaguacagugcaaugaggga

SEQ ID NO: 5154 - RNA, 25 nt, Artificial Sequence
  Description of Artificial Sequence: Synthetic oligonucleotide
cagugcaaugagggaccaguacaug

SEQ ID NO: 5155 - RNA, 25 nt, Artificial Sequence
  Description of Artificial Sequence: Synthetic oligonucleotide
uggggagggcuuucuuuguguauuu

SEQ ID NO: 5156 - RNA, 25 nt, Artificial Sequence
  Description of Artificial Sequence: Synthetic oligonucleotide
ggagggcuuucuuuguguauuugcc

SEQ ID NO: 5157 - RNA, 25 nt, Artificial Sequence
  Description of Artificial Sequence: Synthetic oligonucleotide
agggcuuucuuuguguauuugccau

SEQ ID NO: 5158 - RNA, 25 nt, Artificial Sequence
  Description of Artificial Sequence: Synthetic oligonucleotide
cuuucuuuguguauuugccauaaau

SEQ ID NO: 5159 - RNA, 25 nt, Artificial Sequence
  Description of Artificial Sequence: Synthetic oligonucleotide
uuuguguauuugccauaaauaauac

SEQ ID NO: 5160 - RNA, 25 nt, Artificial Sequence
  Description of Artificial Sequence: Synthetic oligonucleotide
uuguguauuugccauaaauaauacu

SEQ ID NO: 5161 - RNA, 25 nt, Artificial Sequence
  Description of Artificial Sequence: Synthetic oligonucleotide
uguguauuugccauaaauaauacua

SEQ ID NO: 5162 - RNA, 25 nt, Artificial Sequence
  Description of Artificial Sequence: Synthetic oligonucleotide
guguauuugccauaaauaauacuaa

SEQ ID NO: 5163 - RNA, 25 nt, Artificial Sequence
  Description of Artificial Sequence: Synthetic oligonucleotide
uguauuugccauaaauaauacuaaa

SEQ ID NO: 5164 - RNA, 25 nt, Artificial Sequence
  Description of Artificial Sequence: Synthetic oligonucleotide
guauuugccauaaauaauacuaaau

SEQ ID NO: 5165 - RNA, 25 nt, Artificial Sequence
  Description of Artificial Sequence: Synthetic oligonucleotide
auaaauaauacuaaaucauuugaag

SEQ ID NO: 5166 - RNA, 25 nt, Artificial Sequence
  Description of Artificial Sequence: Synthetic oligonucleotide
uaauacuaaaucauuugaagauauu

SEQ ID NO: 5167 - RNA, 25 nt, Artificial Sequence
  Description of Artificial Sequence: Synthetic oligonucleotide
acuaaaucauuugaagauauucacc

SEQ ID NO: 5168 - RNA, 25 nt, Artificial Sequence
  Description of Artificial Sequence: Synthetic oligonucleotide
uaaaucauuugaagauauucaccau

SEQ ID NO: 5169 - RNA, 25 nt, Artificial Sequence
  Description of Artificial Sequence: Synthetic oligonucleotide
cauuugaagauauucaccauuauag

SEQ ID NO: 5170 - RNA, 25 nt, Artificial Sequence
  Description of Artificial Sequence: Synthetic oligonucleotide
gaagauauucaccauuauagagaac

SEQ ID NO: 5171 - RNA, 25 nt, Artificial Sequence
  Description of Artificial Sequence: Synthetic oligonucleotide
agauauucaccauuauagagaacaa

SEQ ID NO: 5172 - RNA, 25 nt, Artificial Sequence
  Description of Artificial Sequence: Synthetic oligonucleotide
cuaugguccuaguaggaaauaaaug

SEQ ID NO: 5173 - RNA, 25 nt, Artificial Sequence
  Description of Artificial Sequence: Synthetic oligonucleotide
gauuugccuucuagaacaguagaca

SEQ ID NO: 5174 - RNA, 25 nt, Artificial Sequence
  Description of Artificial Sequence: Synthetic oligonucleotide
gaugaugccuucuauacauuaguuc

SEQ ID NO: 5175 - RNA, 25 nt, Artificial Sequence
  Description of Artificial Sequence: Synthetic oligonucleotide
cauuaguucgagaaauucgaaaaca

SEQ ID NO: 5176 - RNA, 25 nt, Artificial Sequence
  Description of Artificial Sequence: Synthetic oligonucleotide
agaaauucgaaaacauaaagaaaag

SEQ ID NO: 5177 - RNA, 25 nt, Artificial Sequence
  Description of Artificial Sequence: Synthetic oligonucleotide
aaaacauaaagaaaagaugagcaaa

SEQ ID NO: 5178 - RNA, 25 nt, Artificial Sequence
  Description of Artificial Sequence: Synthetic oligonucleotide
auaaagaaaagaugagcaaagaugg

SEQ ID NO: 5179 - RNA, 25 nt, Artificial Sequence
  Description of Artificial Sequence: Synthetic oligonucleotide
auaaagaaaagaugagcaaagacgg

SEQ ID NO: 5180 - RNA, 25 nt, Artificial Sequence
  Description of Artificial Sequence: Synthetic oligonucleotide
uuguacauuacacuaaauuauuagc

SEQ ID NO: 5181 - RNA, 25 nt, Artificial Sequence
  Description of Artificial Sequence: Synthetic oligonucleotide
aauuauuagcauuuguuuuagcauu

SEQ ID NO: 5182 - RNA, 25 nt, Artificial Sequence
  Description of Artificial Sequence: Synthetic oligonucleotide
uuagcauuuguuuuagcauuaccua

SEQ ID NO: 5183 - RNA, 25 nt, Artificial Sequence
  Description of Artificial Sequence: Synthetic oligonucleotide
aguuuuuuuuuccucuaagugccag

SEQ ID NO: 5184 - RNA, 25 nt, Artificial Sequence
  Description of Artificial Sequence: Synthetic oligonucleotide
aagugccaguauucccagaguuuug

SEQ ID NO: 5185 - RNA, 25 nt, Artificial Sequence
  Description of Artificial Sequence: Synthetic oligonucleotide
ggugugaaacaaauuaaugaagcuu

SEQ ID NO: 5186 - RNA, 25 nt, Artificial Sequence
  Description of Artificial Sequence: Synthetic oligonucleotide
auuaauuacuaauuucaguugagac

SEQ ID NO: 5187 - RNA, 25 nt, Artificial Sequence
  Description of Artificial Sequence: Synthetic oligonucleotide
uauauuuacaugcuacuaaauuuuu

SEQ ID NO: 5188 - RNA, 25 nt, Artificial Sequence
  Description of Artificial Sequence: Synthetic oligonucleotide
uuuaacuauuuuuguauaguguaaa

SEQ ID NO: 5189 - RNA, 25 nt, Artificial Sequence
  Description of Artificial Sequence: Synthetic oligonucleotide
cagugugauccaguuguuuuccauc

SEQ ID NO: 5190 - RNA, 25 nt, Artificial Sequence
  Description of Artificial Sequence: Synthetic oligonucleotide
cugaaaaugacugaauauaaacuug

SEQ ID NO: 5191 - RNA, 25 nt, Artificial Sequence
  Description of Artificial Sequence: Synthetic oligonucleotide
augacugaauauaaacuugugguag

SEQ ID NO: 5192 - RNA, 25 nt, Artificial Sequence
  Description of Artificial Sequence: Synthetic oligonucleotide
cugaauauaaacuugugguaguugg

SEQ ID NO: 5193 - RNA, 25 nt, Artificial Sequence
  Description of Artificial Sequence: Synthetic oligonucleotide
cuaauucagaaucauuuuguggacg

SEQ ID NO: 5194 - RNA, 25 nt, Artificial Sequence
  Description of Artificial Sequence: Synthetic oligonucleotide
gaauaugauccaacaauagaggauu

SEQ ID NO: 5195 - RNA, 25 nt, Artificial Sequence
  Description of Artificial Sequence: Synthetic oligonucleotide
caaguaguaauugauggagaaaccu

SEQ ID NO: 5196 - RNA, 25 nt, Artificial Sequence
  Description of Artificial Sequence: Synthetic oligonucleotide
agggcuuucuuuguguauuugccau

SEQ ID NO: 5197 - RNA, 25 nt, Artificial Sequence
  Description of Artificial Sequence: Synthetic oligonucleotide
uuuguguauuugccauaaauaauac

SEQ ID NO: 5198 - RNA, 25 nt, Artificial Sequence
  Description of Artificial Sequence: Synthetic oligonucleotide
uuguguauuugccauaaauaauacu

SEQ ID NO: 5199 - RNA, 25 nt, Artificial Sequence
  Description of Artificial Sequence: Synthetic oligonucleotide
uguguauuugccauaaauaauacua

SEQ ID NO: 5200 - RNA, 25 nt, Artificial Sequence
  Description of Artificial Sequence: Synthetic oligonucleotide
guguauuugccauaaauaauacuaa

SEQ ID NO: 5201 - RNA, 25 nt, Artificial Sequence
  Description of Artificial Sequence: Synthetic oligonucleotide
auuugccauaaauaauacuaaauca

SEQ ID NO: 5202 - RNA, 25 nt, Artificial Sequence
  Description of Artificial Sequence: Synthetic oligonucleotide
uuugccauaaauaauacuaaaucau

SEQ ID NO: 5203 - RNA, 25 nt, Artificial Sequence
  Description of Artificial Sequence: Synthetic oligonucleotide
auaaauaauacuaaaucauuugaag

SEQ ID NO: 5204 - RNA, 25 nt, Artificial Sequence
  Description of Artificial Sequence: Synthetic oligonucleotide
uaaauaauacuaaaucauuugaaga

SEQ ID NO: 5205 - RNA, 25 nt, Artificial Sequence
  Description of Artificial Sequence: Synthetic oligonucleotide
aauaauacuaaaucauuugaagaua

SEQ ID NO: 5206 - RNA, 25 nt, Artificial Sequence
  Description of Artificial Sequence: Synthetic oligonucleotide
auaauacuaaaucauuugaagauau

SEQ ID NO: 5207 - RNA, 25 nt, Artificial Sequence
  Description of Artificial Sequence: Synthetic oligonucleotide
uaauacuaaaucauuugaagauauu

SEQ ID NO: 5208 - RNA, 25 nt, Artificial Sequence
  Description of Artificial Sequence: Synthetic oligonucleotide
aauacuaaaucauuugaagauauuc

SEQ ID NO: 5209 - RNA, 25 nt, Artificial Sequence
  Description of Artificial Sequence: Synthetic oligonucleotide
uugaagauauucaccauuauagaga

SEQ ID NO: 5210 - RNA, 25 nt, Artificial Sequence
  Description of Artificial Sequence: Synthetic oligonucleotide
gaagauauucaccauuauagagaac

SEQ ID NO: 5211 - RNA, 25 nt, Artificial Sequence
  Description of Artificial Sequence: Synthetic oligonucleotide
aagauauucaccauuauagagaaca

SEQ ID NO: 5212 - RNA, 25 nt, Artificial Sequence
  Description of Artificial Sequence: Synthetic oligonucleotide
agauauucaccauuauagagaacaa

SEQ ID NO: 5213 - RNA, 25 nt, Artificial Sequence
  Description of Artificial Sequence: Synthetic oligonucleotide
gauauucaccauuauagagaacaaa

SEQ ID NO: 5214 - RNA, 25 nt, Artificial Sequence
  Description of Artificial Sequence: Synthetic oligonucleotide
auuauagagaacaaauuaaaagagu

SEQ ID NO: 5215 - RNA, 25 nt, Artificial Sequence
  Description of Artificial Sequence: Synthetic oligonucleotide
uauagagaacaaauuaaaagaguua

SEQ ID NO: 5216 - RNA, 25 nt, Artificial Sequence
  Description of Artificial Sequence: Synthetic oligonucleotide
auagagaacaaauuaaaagaguuaa

SEQ ID NO: 5217 - RNA, 25 nt, Artificial Sequence
  Description of Artificial Sequence: Synthetic oligonucleotide
uagagaacaaauuaaaagaguuaag

SEQ ID NO: 5218 - RNA, 25 nt, Artificial Sequence
  Description of Artificial Sequence: Synthetic oligonucleotide
agagaacaaauuaaaagaguuaagg

SEQ ID NO: 5219 - RNA, 25 nt, Artificial Sequence
  Description of Artificial Sequence: Synthetic oligonucleotide
aguaggaaauaaaugugauuugccu

SEQ ID NO: 5220 - RNA, 25 nt, Artificial Sequence
  Description of Artificial Sequence: Synthetic oligonucleotide
guaggaaauaaaugugauuugccuu

SEQ ID NO: 5221 - RNA, 25 nt, Artificial Sequence
  Description of Artificial Sequence: Synthetic oligonucleotide
gaaguuauggaauuccuuuuauuga

SEQ ID NO: 5222 - RNA, 25 nt, Artificial Sequence
  Description of Artificial Sequence: Synthetic oligonucleotide
guuauggaauuccuuuuauugaaac

SEQ ID NO: 5223 - RNA, 25 nt, Artificial Sequence
  Description of Artificial Sequence: Synthetic oligonucleotide
uuauggaauuccuuuuauugaaaca

SEQ ID NO: 5224 - RNA, 25 nt, Artificial Sequence
  Description of Artificial Sequence: Synthetic oligonucleotide
uauggaauuccuuuuauugaaacau

SEQ ID NO: 5225 - RNA, 25 nt, Artificial Sequence
  Description of Artificial Sequence: Synthetic oligonucleotide
auggaauuccuuuuauugaaacauc

SEQ ID NO: 5226 - RNA, 25 nt, Artificial Sequence
  Description of Artificial Sequence: Synthetic oligonucleotide
gaggaugcuuuuuauacauugguga

SEQ ID NO: 5227 - RNA, 25 nt, Artificial Sequence
  Description of Artificial Sequence: Synthetic oligonucleotide
ggaugcuuuuuauacauuggugagg

SEQ ID NO: 5228 - RNA, 25 nt, Artificial Sequence
  Description of Artificial Sequence: Synthetic oligonucleotide
agauugaaaaaaaucagcaaagaag

SEQ ID NO: 5229 - RNA, 25 nt, Artificial Sequence
  Description of Artificial Sequence: Synthetic oligonucleotide
gauugaaaaaaaucagcaaagaaga

SEQ ID NO: 5230 - RNA, 25 nt, Artificial Sequence
  Description of Artificial Sequence: Synthetic oligonucleotide
uugaaaaaaaucagcaaagaagaaa

SEQ ID NO: 5231 - RNA, 25 nt, Artificial Sequence
  Description of Artificial Sequence: Synthetic oligonucleotide
ugaaaaaaaucagcaaagaagaaaa

SEQ ID NO: 5232 - RNA, 25 nt, Artificial Sequence
  Description of Artificial Sequence: Synthetic oligonucleotide
gaaaaaaaucagcaaagaagaaaag

SEQ ID NO: 5233 - RNA, 25 nt, Artificial Sequence
  Description of Artificial Sequence: Synthetic oligonucleotide
aaaaaaaucagcaaagaagaaaaga

SEQ ID NO: 5234 - RNA, 25 nt, Artificial Sequence
  Description of Artificial Sequence: Synthetic oligonucleotide
cuggcugugugaaaauuaaaaaaug

SEQ ID NO: 5235 - RNA, 25 nt, Artificial Sequence
  Description of Artificial Sequence: Synthetic oligonucleotide
cugugugaaaauuaaaaaaugcauu

SEQ ID NO: 5236 - RNA, 25 nt, Artificial Sequence
  Description of Artificial Sequence: Synthetic oligonucleotide
gugaaaauuaaaaaaugcauuauaa

SEQ ID NO: 5237 - RNA, 25 nt, Artificial Sequence
  Description of Artificial Sequence: Synthetic oligonucleotide
ugaaaauuaaaaaaugcauuauaau

SEQ ID NO: 5238 - RNA, 25 nt, Artificial Sequence
  Description of Artificial Sequence: Synthetic oligonucleotide
gaaaauuaaaaaaugcauuauaaug

SEQ ID NO: 5239 - RNA, 25 nt, Artificial Sequence
  Description of Artificial Sequence: Synthetic oligonucleotide
aaaauuaaaaaaugcauuauaaugu

SEQ ID NO: 5240 - RNA, 25 nt, Artificial Sequence
  Description of Artificial Sequence: Synthetic oligonucleotide
aauuaaaaaaugcauuauaauguaa

SEQ ID NO: 5241 - RNA, 25 nt, Artificial Sequence
  Description of Artificial Sequence: Synthetic oligonucleotide
auuaaaaaaugcauuauaauguaau

SEQ ID NO: 5242 - RNA, 25 nt, Artificial Sequence
  Description of Artificial Sequence: Synthetic oligonucleotide
uuaaaaaaugcauuauaauguaauc

SEQ ID NO: 5243 - RNA, 25 nt, Artificial Sequence
  Description of Artificial Sequence: Synthetic oligonucleotide
uaaaaaaugcauuauaauguaaucu

SEQ ID NO: 5244 - RNA, 25 nt, Artificial Sequence
  Description of Artificial Sequence: Synthetic oligonucleotide
aaaaaugcauuauaauguaaucugg

SEQ ID NO: 5245 - RNA, 25 nt, Artificial Sequence
  Description of Artificial Sequence: Synthetic oligonucleotide
cauuauaauguaaucuggguguuga

SEQ ID NO: 5246 - RNA, 25 nt, Artificial Sequence
  Description of Artificial Sequence: Synthetic oligonucleotide
cgagaaauucgaaaacauaaagaaa

SEQ ID NO: 5247 - RNA, 25 nt, Artificial Sequence
  Description of Artificial Sequence: Synthetic oligonucleotide
gagaaauucgaaaacauaaagaaaa

SEQ ID NO: 5248 - RNA, 25 nt, Artificial Sequence
  Description of Artificial Sequence: Synthetic oligonucleotide
agaaauucgaaaacauaaagaaaag

SEQ ID NO: 5249 - RNA, 25 nt, Artificial Sequence
  Description of Artificial Sequence: Synthetic oligonucleotide
aauucgaaaacauaaagaaaagaug

SEQ ID NO: 5250 - RNA, 25 nt, Artificial Sequence
  Description of Artificial Sequence: Synthetic oligonucleotide
gaaaacauaaagaaaagaugagcaa

SEQ ID NO: 5251 - RNA, 25 nt, Artificial Sequence
  Description of Artificial Sequence: Synthetic oligonucleotide
aaaacauaaagaaaagaugagcaaa

SEQ ID NO: 5252 - RNA, 25 nt, Artificial Sequence
  Description of Artificial Sequence: Synthetic oligonucleotide
agaugguaaaaagaagaaaaagaag

SEQ ID NO: 5253 - RNA, 25 nt, Artificial Sequence
  Description of Artificial Sequence: Synthetic oligonucleotide
gaugguaaaaagaagaaaaagaagu

SEQ ID NO: 5254 - RNA, 25 nt, Artificial Sequence
  Description of Artificial Sequence: Synthetic oligonucleotide
ugguaaaaagaagaaaaagaaguca

SEQ ID NO: 5255 - RNA, 25 nt, Artificial Sequence
  Description of Artificial Sequence: Synthetic oligonucleotide
gguaaaaagaagaaaaagaagucaa

SEQ ID NO: 5256 - RNA, 25 nt, Artificial Sequence
  Description of Artificial Sequence: Synthetic oligonucleotide
aaagaagaaaaagaagucaaagaca

SEQ ID NO: 5257 - RNA, 25 nt, Artificial Sequence
  Description of Artificial Sequence: Synthetic oligonucleotide
aagaagaaaaagaagucaaagacaa

SEQ ID NO: 5258 - RNA, 25 nt, Artificial Sequence
  Description of Artificial Sequence: Synthetic oligonucleotide
agaagaaaaagaagucaaagacaaa

SEQ ID NO: 5259 - RNA, 25 nt, Artificial Sequence
  Description of Artificial Sequence: Synthetic oligonucleotide
aaagacaaaguguguaauuauguaa

SEQ ID NO: 5260 - RNA, 25 nt, Artificial Sequence
  Description of Artificial Sequence: Synthetic oligonucleotide
aagacaaaguguguaauuauguaaa

SEQ ID NO: 5261 - RNA, 25 nt, Artificial Sequence
  Description of Artificial Sequence: Synthetic oligonucleotide
caaaguguguaauuauguaaauaca

SEQ ID NO: 5262 - RNA, 25 nt, Artificial Sequence
  Description of Artificial Sequence: Synthetic oligonucleotide
aaguguguaauuauguaaauacaau

SEQ ID NO: 5263 - RNA, 25 nt, Artificial Sequence
  Description of Artificial Sequence: Synthetic oligonucleotide
guguaauuauguaaauacaauuugu

SEQ ID NO: 5264 - RNA, 25 nt, Artificial Sequence
  Description of Artificial Sequence: Synthetic oligonucleotide
guaauuauguaaauacaauuuguac

SEQ ID NO: 5265 - RNA, 25 nt, Artificial Sequence
  Description of Artificial Sequence: Synthetic oligonucleotide
aauuauguaaauacaauuuguacuu

SEQ ID NO: 5266 - RNA, 25 nt, Artificial Sequence
  Description of Artificial Sequence: Synthetic oligonucleotide
auuauguaaauacaauuuguacuuu

SEQ ID NO: 5267 - RNA, 25 nt, Artificial Sequence
  Description of Artificial Sequence: Synthetic oligonucleotide
uguaaauacaauuuguacuuuuuuc

SEQ ID NO: 5268 - RNA, 25 nt, Artificial Sequence
  Description of Artificial Sequence: Synthetic oligonucleotide
guaaauacaauuuguacuuuuuucu

SEQ ID NO: 5269 - RNA, 25 nt, Artificial Sequence
  Description of Artificial Sequence: Synthetic oligonucleotide
uaaauacaauuuguacuuuuuucuu

SEQ ID NO: 5270 - RNA, 25 nt, Artificial Sequence
  Description of Artificial Sequence: Synthetic oligonucleotide
aaauacaauuuguacuuuuuucuua

SEQ ID NO: 5271 - RNA, 25 nt, Artificial Sequence
  Description of Artificial Sequence: Synthetic oligonucleotide
aauuuguacuuuuuucuuaaggcau

SEQ ID NO: 5272 - RNA, 25 nt, Artificial Sequence
  Description of Artificial Sequence: Synthetic oligonucleotide
auuuguacuuuuuucuuaaggcaua

SEQ ID NO: 5273 - RNA, 25 nt, Artificial Sequence
  Description of Artificial Sequence: Synthetic oligonucleotide
cuaguacaagugguaauuuuuguac

SEQ ID NO: 5274 - RNA, 25 nt, Artificial Sequence
  Description of Artificial Sequence: Synthetic oligonucleotide
uaguacaagugguaauuuuuguaca

SEQ ID NO: 5275 - RNA, 25 nt, Artificial Sequence
  Description of Artificial Sequence: Synthetic oligonucleotide
aagugguaauuuuuguacauuacac

SEQ ID NO: 5276 - RNA, 25 nt, Artificial Sequence
  Description of Artificial Sequence: Synthetic oligonucleotide
agugguaauuuuuguacauuacacu

SEQ ID NO: 5277 - RNA, 25 nt, Artificial Sequence
  Description of Artificial Sequence: Synthetic oligonucleotide
auuuuuguacauuacacuaaauuau

SEQ ID NO: 5278 - RNA, 25 nt, Artificial Sequence
  Description of Artificial Sequence: Synthetic oligonucleotide
uuuuuguacauuacacuaaauuauu

SEQ ID NO: 5279 - RNA, 25 nt, Artificial Sequence
  Description of Artificial Sequence: Synthetic oligonucleotide
uuuuguacauuacacuaaauuauua

SEQ ID NO: 5280 - RNA, 25 nt, Artificial Sequence
  Description of Artificial Sequence: Synthetic oligonucleotide
uuuguacauuacacuaaauuauuag

SEQ ID NO: 5281 - RNA, 25 nt, Artificial Sequence
  Description of Artificial Sequence: Synthetic oligonucleotide
uuguacauuacacuaaauuauuagc

SEQ ID NO: 5282 - RNA, 25 nt, Artificial Sequence
  Description of Artificial Sequence: Synthetic oligonucleotide
cuaaauuauuagcauuuguuuuagc

SEQ ID NO: 5283 - RNA, 25 nt, Artificial Sequence
  Description of Artificial Sequence: Synthetic oligonucleotide
aaauuauuagcauuuguuuuagcau

SEQ ID NO: 5284 - RNA, 25 nt, Artificial Sequence
  Description of Artificial Sequence: Synthetic oligonucleotide
aauuauuagcauuuguuuuagcauu

SEQ ID NO: 5285 - RNA, 25 nt, Artificial Sequence
  Description of Artificial Sequence: Synthetic oligonucleotide
uuagcauuuguuuuagcauuaccua

SEQ ID NO: 5286 - RNA, 25 nt, Artificial Sequence
  Description of Artificial Sequence: Synthetic oligonucleotide
uuuguuuuagcauuaccuaauuuuu

SEQ ID NO: 5287 - RNA, 25 nt, Artificial Sequence
  Description of Artificial Sequence: Synthetic oligonucleotide
uuguuuuagcauuaccuaauuuuuu

SEQ ID NO: 5288 - RNA, 25 nt, Artificial Sequence
  Description of Artificial Sequence: Synthetic oligonucleotide
guuuuagcauuaccuaauuuuuuuc

SEQ ID NO: 5289 - RNA, 25 nt, Artificial Sequence
  Description of Artificial Sequence: Synthetic oligonucleotide
uuuuagcauuaccuaauuuuuuucc

SEQ ID NO: 5290 - RNA, 25 nt, Artificial Sequence
  Description of Artificial Sequence: Synthetic oligonucleotide
uuuagcauuaccuaauuuuuuuccu

SEQ ID NO: 5291 - RNA, 25 nt, Artificial Sequence
  Description of Artificial Sequence: Synthetic oligonucleotide
uuagcauuaccuaauuuuuuuccug

SEQ ID NO: 5292 - RNA, 25 nt, Artificial Sequence
  Description of Artificial Sequence: Synthetic oligonucleotide
cuguuagcuuuuaccuuaaaugcuu

SEQ ID NO: 5293 - RNA, 25 nt, Artificial Sequence
  Description of Artificial Sequence: Synthetic oligonucleotide
uguuagcuuuuaccuuaaaugcuua

SEQ ID NO: 5294 - RNA, 25 nt, Artificial Sequence
  Description of Artificial Sequence: Synthetic oligonucleotide
cuuuuaccuuaaaugcuuauuuuaa

SEQ ID NO: 5295 - RNA, 25 nt, Artificial Sequence
  Description of Artificial Sequence: Synthetic oligonucleotide
uuuuaccuuaaaugcuuauuuuaaa

SEQ ID NO: 5296 - RNA, 25 nt, Artificial Sequence
  Description of Artificial Sequence: Synthetic oligonucleotide
uuuaccuuaaaugcuuauuuuaaaa

SEQ ID NO: 5297 - RNA, 25 nt, Artificial Sequence
  Description of Artificial Sequence: Synthetic oligonucleotide
uuaaaugcuuauuuuaaaaugacag

SEQ ID NO: 5298 - RNA, 25 nt, Artificial Sequence
  Description of Artificial Sequence: Synthetic oligonucleotide
uaaaugcuuauuuuaaaaugacagu

SEQ ID NO: 5299 - RNA, 25 nt, Artificial Sequence
  Description of Artificial Sequence: Synthetic oligonucleotide
cuuauuuuaaaaugacaguggaagu

SEQ ID NO: 5300 - RNA, 25 nt, Artificial Sequence
  Description of Artificial Sequence: Synthetic oligonucleotide
uauuuuaaaaugacaguggaaguuu

SEQ ID NO: 5301 - RNA, 25 nt, Artificial Sequence
  Description of Artificial Sequence: Synthetic oligonucleotide
ggaaguuuuuuuuuccucuaagugc

SEQ ID NO: 5302 - RNA, 25 nt, Artificial Sequence
  Description of Artificial Sequence: Synthetic oligonucleotide
aaguuuuuuuuuccucuaagugcca

SEQ ID NO: 5303 - RNA, 25 nt, Artificial Sequence
  Description of Artificial Sequence: Synthetic oligonucleotide
aguuuuuuuuuccucuaagugccag

SEQ ID NO: 5304 - RNA, 25 nt, Artificial Sequence
  Description of Artificial Sequence: Synthetic oligonucleotide
uugguuuuugaacuagcaaugccug

SEQ ID NO: 5305 - RNA, 25 nt, Artificial Sequence
  Description of Artificial Sequence: Synthetic oligonucleotide
cugugaaaaagaaacugaauaccua

SEQ ID NO: 5306 - RNA, 25 nt, Artificial Sequence
  Description of Artificial Sequence: Synthetic oligonucleotide
aaagaaacugaauaccuaagauuuc

SEQ ID NO: 5307 - RNA, 25 nt, Artificial Sequence
  Description of Artificial Sequence: Synthetic oligonucleotide
aagaaacugaauaccuaagauuucu

SEQ ID NO: 5308 - RNA, 25 nt, Artificial Sequence
  Description of Artificial Sequence: Synthetic oligonucleotide
cugaauaccuaagauuucugucuug

SEQ ID NO: 5309 - RNA, 25 nt, Artificial Sequence
  Description of Artificial Sequence: Synthetic oligonucleotide
caguugauuacuucuuauuuuucuu

SEQ ID NO: 5310 - RNA, 25 nt, Artificial Sequence
  Description of Artificial Sequence: Synthetic oligonucleotide
aguugauuacuucuuauuuuucuua

SEQ ID NO: 5311 - RNA, 25 nt, Artificial Sequence
  Description of Artificial Sequence: Synthetic oligonucleotide
gauuacuucuuauuuuucuuaccaa

SEQ ID NO: 5312 - RNA, 25 nt, Artificial Sequence
  Description of Artificial Sequence: Synthetic oligonucleotide
cuuauuuuucuuaccaauugugaau

SEQ ID NO: 5313 - RNA, 25 nt, Artificial Sequence
  Description of Artificial Sequence: Synthetic oligonucleotide
uuauuuuucuuaccaauugugaaug

SEQ ID NO: 5314 - RNA, 25 nt, Artificial Sequence
  Description of Artificial Sequence: Synthetic oligonucleotide
uauuuuucuuaccaauugugaaugu

SEQ ID NO: 5315 - RNA, 25 nt, Artificial Sequence
  Description of Artificial Sequence: Synthetic oligonucleotide
guuggugugaaacaaauuaaugaag

SEQ ID NO: 5316 - RNA, 25 nt, Artificial Sequence
  Description of Artificial Sequence: Synthetic oligonucleotide
ggugugaaacaaauuaaugaagcuu

SEQ ID NO: 5317 - RNA, 25 nt, Artificial Sequence
  Description of Artificial Sequence: Synthetic oligonucleotide
gugugaaacaaauuaaugaagcuuu

SEQ ID NO: 5318 - RNA, 25 nt, Artificial Sequence
  Description of Artificial Sequence: Synthetic oligonucleotide
caaauuaaugaagcuuuugaaucau

SEQ ID NO: 5319 - RNA, 25 nt, Artificial Sequence
  Description of Artificial Sequence: Synthetic oligonucleotide
aaauuaaugaagcuuuugaaucauc

SEQ ID NO: 5320 - RNA, 25 nt, Artificial Sequence
  Description of Artificial Sequence: Synthetic oligonucleotide
uguguuuuaucuagucacauaaaug

SEQ ID NO: 5321 - RNA, 25 nt, Artificial Sequence
  Description of Artificial Sequence: Synthetic oligonucleotide
guguuuuaucuagucacauaaaugg

SEQ ID NO: 5322 - RNA, 25 nt, Artificial Sequence
  Description of Artificial Sequence: Synthetic oligonucleotide
uuuuaucuagucacauaaauggauu

SEQ ID NO: 5323 - RNA, 25 nt, Artificial Sequence
  Description of Artificial Sequence: Synthetic oligonucleotide
uuuaucuagucacauaaauggauua

SEQ ID NO: 5324 - RNA, 25 nt, Artificial Sequence
  Description of Artificial Sequence: Synthetic oligonucleotide
cuagucacauaaauggauuaauuac

SEQ ID NO: 5325 - RNA, 25 nt, Artificial Sequence
  Description of Artificial Sequence: Synthetic oligonucleotide
uagucacauaaauggauuaauuacu

SEQ ID NO: 5326 - RNA, 25 nt, Artificial Sequence
  Description of Artificial Sequence: Synthetic oligonucleotide
uaaauggauuaauuacuaauuucag

SEQ ID NO: 5327 - RNA, 25 nt, Artificial Sequence
  Description of Artificial Sequence: Synthetic oligonucleotide
aaauggauuaauuacuaauuucagu

SEQ ID NO: 5328 - RNA, 25 nt, Artificial Sequence
  Description of Artificial Sequence: Synthetic oligonucleotide
gauuaauuacuaauuucaguugaga

SEQ ID NO: 5329 - RNA, 25 nt, Artificial Sequence
  Description of Artificial Sequence: Synthetic oligonucleotide
uuaauuacuaauuucaguugagacc

SEQ ID NO: 5330 - RNA, 25 nt, Artificial Sequence
  Description of Artificial Sequence: Synthetic oligonucleotide
uaauuacuaauuucaguugagaccu

SEQ ID NO: 5331 - RNA, 25 nt, Artificial Sequence
  Description of Artificial Sequence: Synthetic oligonucleotide
aauuacuaauuucaguugagaccuu

SEQ ID NO: 5332 - RNA, 25 nt, Artificial Sequence
  Description of Artificial Sequence: Synthetic oligonucleotide
auugguuuuuacugaaacauugagg

SEQ ID NO: 5333 - RNA, 25 nt, Artificial Sequence
  Description of Artificial Sequence: Synthetic oligonucleotide
guuuuuacugaaacauugagggaac

SEQ ID NO: 5334 - RNA, 25 nt, Artificial Sequence
  Description of Artificial Sequence: Synthetic oligonucleotide
uuuuuacugaaacauugagggaaca

SEQ ID NO: 5335 - RNA, 25 nt, Artificial Sequence
  Description of Artificial Sequence: Synthetic oligonucleotide
ugagggaacacaaauuuaugggcuu

SEQ ID NO: 5336 - RNA, 25 nt, Artificial Sequence
  Description of Artificial Sequence: Synthetic oligonucleotide
gagggaacacaaauuuaugggcuuc

SEQ ID NO: 5337 - RNA, 25 nt, Artificial Sequence
  Description of Artificial Sequence: Synthetic oligonucleotide
augaauguaaaguuacacuguucac

SEQ ID NO: 5338 - RNA, 25 nt, Artificial Sequence
  Description of Artificial Sequence: Synthetic oligonucleotide
ugaauguaaaguuacacuguucaca

SEQ ID NO: 5339 - RNA, 25 nt, Artificial Sequence
  Description of Artificial Sequence: Synthetic oligonucleotide
aaaauauuauauuuuuucuauaaaa

SEQ ID NO: 5340 - RNA, 25 nt, Artificial Sequence
  Description of Artificial Sequence: Synthetic oligonucleotide
aaauauuauauuuuuucuauaaaaa

SEQ ID NO: 5341 - RNA, 25 nt, Artificial Sequence
  Description of Artificial Sequence: Synthetic oligonucleotide
aauauuauauuuuuucuauaaaaag

SEQ ID NO: 5342 - RNA, 25 nt, Artificial Sequence
  Description of Artificial Sequence: Synthetic oligonucleotide
auauuauauuuuuucuauaaaaaga

SEQ ID NO: 5343 - RNA, 25 nt, Artificial Sequence
  Description of Artificial Sequence: Synthetic oligonucleotide
auuauauuuuuucuauaaaaagaaa

SEQ ID NO: 5344 - RNA, 25 nt, Artificial Sequence
  Description of Artificial Sequence: Synthetic oligonucleotide
uuauauuuuuucuauaaaaagaaaa

SEQ ID NO: 5345 - RNA, 25 nt, Artificial Sequence
  Description of Artificial Sequence: Synthetic oligonucleotide
uauauuuuuucuauaaaaagaaaaa

SEQ ID NO: 5346 - RNA, 25 nt, Artificial Sequence
  Description of Artificial Sequence: Synthetic oligonucleotide
auauuuuuucuauaaaaagaaaaaa

SEQ ID NO: 5347 - RNA, 25 nt, Artificial Sequence
  Description of Artificial Sequence: Synthetic oligonucleotide
uauuuuuucuauaaaaagaaaaaaa

SEQ ID NO: 5348 - RNA, 25 nt, Artificial Sequence
  Description of Artificial Sequence: Synthetic oligonucleotide
auuuuuucuauaaaaagaaaaaaau

SEQ ID NO: 5349 - RNA, 25 nt, Artificial Sequence
  Description of Artificial Sequence: Synthetic oligonucleotide
uuuuuucuauaaaaagaaaaaaaug

SEQ ID NO: 5350 - RNA, 25 nt, Artificial Sequence
  Description of Artificial Sequence: Synthetic oligonucleotide
uuuuucuauaaaaagaaaaaaaugg

SEQ ID NO: 5351 - RNA, 25 nt, Artificial Sequence
  Description of Artificial Sequence: Synthetic oligonucleotide
cuauaaaaagaaaaaaauggaaaaa

SEQ ID NO: 5352 - RNA, 25 nt, Artificial Sequence
  Description of Artificial Sequence: Synthetic oligonucleotide
uauaaaaagaaaaaaauggaaaaaa

SEQ ID NO: 5353 - RNA, 25 nt, Artificial Sequence
  Description of Artificial Sequence: Synthetic oligonucleotide
uaaaaagaaaaaaauggaaaaaaau

SEQ ID NO: 5354 - RNA, 25 nt, Artificial Sequence
  Description of Artificial Sequence: Synthetic oligonucleotide
aaaaagaaaaaaauggaaaaaaauu

SEQ ID NO: 5355 - RNA, 25 nt, Artificial Sequence
  Description of Artificial Sequence: Synthetic oligonucleotide
aaaagaaaaaaauggaaaaaaauua

SEQ ID NO: 5356 - RNA, 25 nt, Artificial Sequence
  Description of Artificial Sequence: Synthetic oligonucleotide
aaagaaaaaaauggaaaaaaauuac

SEQ ID NO: 5357 - RNA, 25 nt, Artificial Sequence
  Description of Artificial Sequence: Synthetic oligonucleotide
aagaaaaaaauggaaaaaaauuaca

SEQ ID NO: 5358 - RNA, 25 nt, Artificial Sequence
  Description of Artificial Sequence: Synthetic oligonucleotide
agaaaaaaauggaaaaaaauuacaa

SEQ ID NO: 5359 - RNA, 25 nt, Artificial Sequence
  Description of Artificial Sequence: Synthetic oligonucleotide
gaaaaaaauggaaaaaaauuacaag

SEQ ID NO: 5360 - RNA, 25 nt, Artificial Sequence
  Description of Artificial Sequence: Synthetic oligonucleotide
aaaauggaaaaaaauuacaaggcaa

SEQ ID NO: 5361 - RNA, 25 nt, Artificial Sequence
  Description of Artificial Sequence: Synthetic oligonucleotide
aaauggaaaaaaauuacaaggcaau

SEQ ID NO: 5362 - RNA, 25 nt, Artificial Sequence
  Description of Artificial Sequence: Synthetic oligonucleotide
gaaaaaaauuacaaggcaauggaaa

SEQ ID NO: 5363 - RNA, 25 nt, Artificial Sequence
  Description of Artificial Sequence: Synthetic oligonucleotide
aaaaaaauuacaaggcaauggaaac

SEQ ID NO: 5364 - RNA, 25 nt, Artificial Sequence
  Description of Artificial Sequence: Synthetic oligonucleotide
aaaaaauuacaaggcaauggaaacu

SEQ ID NO: 5365 - RNA, 25 nt, Artificial Sequence
  Description of Artificial Sequence: Synthetic oligonucleotide
cauuuccuuuucacauuagauaaau

SEQ ID NO: 5366 - RNA, 25 nt, Artificial Sequence
  Description of Artificial Sequence: Synthetic oligonucleotide
cuuuucacauuagauaaauuacuau

SEQ ID NO: 5367 - RNA, 25 nt, Artificial Sequence
  Description of Artificial Sequence: Synthetic oligonucleotide
cauuagauaaauuacuauaaagacu

SEQ ID NO: 5368 - RNA, 25 nt, Artificial Sequence
  Description of Artificial Sequence: Synthetic oligonucleotide
auuagauaaauuacuauaaagacuc

SEQ ID NO: 5369 - RNA, 25 nt, Artificial Sequence
  Description of Artificial Sequence: Synthetic oligonucleotide
uuagauaaauuacuauaaagacucc

SEQ ID NO: 5370 - RNA, 25 nt, Artificial Sequence
  Description of Artificial Sequence: Synthetic oligonucleotide
uaugaaauggggauuauuauagcaa

SEQ ID NO: 5371 - RNA, 25 nt, Artificial Sequence
  Description of Artificial Sequence: Synthetic oligonucleotide
gggauuauuauagcaaccauuuugg

SEQ ID NO: 5372 - RNA, 25 nt, Artificial Sequence
  Description of Artificial Sequence: Synthetic oligonucleotide
cuauauuuacaugcuacuaaauuuu

SEQ ID NO: 5373 - RNA, 25 nt, Artificial Sequence
  Description of Artificial Sequence: Synthetic oligonucleotide
uauauuuacaugcuacuaaauuuuu

SEQ ID NO: 5374 - RNA, 25 nt, Artificial Sequence
  Description of Artificial Sequence: Synthetic oligonucleotide
auauuuacaugcuacuaaauuuuua

SEQ ID NO: 5375 - RNA, 25 nt, Artificial Sequence
  Description of Artificial Sequence: Synthetic oligonucleotide
uauuuacaugcuacuaaauuuuuau

SEQ ID NO: 5376 - RNA, 25 nt, Artificial Sequence
  Description of Artificial Sequence: Synthetic oligonucleotide
auuuacaugcuacuaaauuuuuaua

SEQ ID NO: 5377 - RNA, 25 nt, Artificial Sequence
  Description of Artificial Sequence: Synthetic oligonucleotide
caugcuacuaaauuuuuauaauaau

SEQ ID NO: 5378 - RNA, 25 nt, Artificial Sequence
  Description of Artificial Sequence: Synthetic oligonucleotide
cuaaauuuuuauaauaauugaaaag

SEQ ID NO: 5379 - RNA, 25 nt, Artificial Sequence
  Description of Artificial Sequence: Synthetic oligonucleotide
uaaauuuuuauaauaauugaaaaga

SEQ ID NO: 5380 - RNA, 25 nt, Artificial Sequence
  Description of Artificial Sequence: Synthetic oligonucleotide
aauuuuuauaauaauugaaaagauu

SEQ ID NO: 5381 - RNA, 25 nt, Artificial Sequence
  Description of Artificial Sequence: Synthetic oligonucleotide
auuuuuauaauaauugaaaagauuu

SEQ ID NO: 5382 - RNA, 25 nt, Artificial Sequence
  Description of Artificial Sequence: Synthetic oligonucleotide
uuuuuauaauaauugaaaagauuuu

SEQ ID NO: 5383 - RNA, 25 nt, Artificial Sequence
  Description of Artificial Sequence: Synthetic oligonucleotide
uuuuauaauaauugaaaagauuuua

SEQ ID NO: 5384 - RNA, 25 nt, Artificial Sequence
  Description of Artificial Sequence: Synthetic oligonucleotide
uuuauaauaauugaaaagauuuuaa

SEQ ID NO: 5385 - RNA, 25 nt, Artificial Sequence
  Description of Artificial Sequence: Synthetic oligonucleotide
uuauaauaauugaaaagauuuuaac

SEQ ID NO: 5386 - RNA, 25 nt, Artificial Sequence
  Description of Artificial Sequence: Synthetic oligonucleotide
uauaauaauugaaaagauuuuaaca

SEQ ID NO: 5387 - RNA, 25 nt, Artificial Sequence
  Description of Artificial Sequence: Synthetic oligonucleotide
auaauaauugaaaagauuuuaacaa

SEQ ID NO: 5388 - RNA, 25 nt, Artificial Sequence
  Description of Artificial Sequence: Synthetic oligonucleotide
uaauaauugaaaagauuuuaacaag

SEQ ID NO: 5389 - RNA, 25 nt, Artificial Sequence
  Description of Artificial Sequence: Synthetic oligonucleotide
aauugaaaagauuuuaacaaguaua

SEQ ID NO: 5390 - RNA, 25 nt, Artificial Sequence
  Description of Artificial Sequence: Synthetic oligonucleotide
auugaaaagauuuuaacaaguauaa

SEQ ID NO: 5391 - RNA, 25 nt, Artificial Sequence
  Description of Artificial Sequence: Synthetic oligonucleotide
ugaaaagauuuuaacaaguauaaaa

SEQ ID NO: 5392 - RNA, 25 nt, Artificial Sequence
  Description of Artificial Sequence: Synthetic oligonucleotide
gaaaagauuuuaacaaguauaaaaa

SEQ ID NO: 5393 - RNA, 25 nt, Artificial Sequence
  Description of Artificial Sequence: Synthetic oligonucleotide
aaaagauuuuaacaaguauaaaaaa

SEQ ID NO: 5394 - RNA, 25 nt, Artificial Sequence
  Description of Artificial Sequence: Synthetic oligonucleotide
aaagauuuuaacaaguauaaaaaau

SEQ ID NO: 5395 - RNA, 25 nt, Artificial Sequence
  Description of Artificial Sequence: Synthetic oligonucleotide
aagauuuuaacaaguauaaaaaauu

SEQ ID NO: 5396 - RNA, 25 nt, Artificial Sequence
  Description of Artificial Sequence: Synthetic oligonucleotide
agauuuuaacaaguauaaaaaauuc

SEQ ID NO: 5397 - RNA, 25 nt, Artificial Sequence
  Description of Artificial Sequence: Synthetic oligonucleotide
gauuuuaacaaguauaaaaaauucu

SEQ ID NO: 5398 - RNA, 25 nt, Artificial Sequence
  Description of Artificial Sequence: Synthetic oligonucleotide
auuuuaacaaguauaaaaaauucuc

SEQ ID NO: 5399 - RNA, 25 nt, Artificial Sequence
  Description of Artificial Sequence: Synthetic oligonucleotide
uuuuaacaaguauaaaaaauucuca

SEQ ID NO: 5400 - RNA, 25 nt, Artificial Sequence
  Description of Artificial Sequence: Synthetic oligonucleotide
aaguauaaaaaauucucauaggaau

SEQ ID NO: 5401 - RNA, 25 nt, Artificial Sequence
  Description of Artificial Sequence: Synthetic oligonucleotide
aguauaaaaaauucucauaggaauu

SEQ ID NO: 5402 - RNA, 25 nt, Artificial Sequence
  Description of Artificial Sequence: Synthetic oligonucleotide
guauaaaaaauucucauaggaauua

SEQ ID NO: 5403 - RNA, 25 nt, Artificial Sequence
  Description of Artificial Sequence: Synthetic oligonucleotide
uauaaaaaauucucauaggaauuaa

SEQ ID NO: 5404 - RNA, 25 nt, Artificial Sequence
  Description of Artificial Sequence: Synthetic oligonucleotide
auaaaaaauucucauaggaauuaaa

SEQ ID NO: 5405 - RNA, 25 nt, Artificial Sequence
  Description of Artificial Sequence: Synthetic oligonucleotide
uaaaaaauucucauaggaauuaaau

SEQ ID NO: 5406 - RNA, 25 nt, Artificial Sequence
  Description of Artificial Sequence: Synthetic oligonucleotide
aaaaaauucucauaggaauuaaaug

SEQ ID NO: 5407 - RNA, 25 nt, Artificial Sequence
  Description of Artificial Sequence: Synthetic oligonucleotide
aaaaauucucauaggaauuaaaugu

SEQ ID NO: 5408 - RNA, 25 nt, Artificial Sequence
  Description of Artificial Sequence: Synthetic oligonucleotide
aaauucucauaggaauuaaauguag

SEQ ID NO: 5409 - RNA, 25 nt, Artificial Sequence
  Description of Artificial Sequence: Synthetic oligonucleotide
aauucucauaggaauuaaauguagu

SEQ ID NO: 5410 - RNA, 25 nt, Artificial Sequence
  Description of Artificial Sequence: Synthetic oligonucleotide
cuuucauaguauaacuuuaaaucuu

SEQ ID NO: 5411 - RNA, 25 nt, Artificial Sequence
  Description of Artificial Sequence: Synthetic oligonucleotide
auaguauaacuuuaaaucuuuucuu

SEQ ID NO: 5412 - RNA, 25 nt, Artificial Sequence
  Description of Artificial Sequence: Synthetic oligonucleotide
uaguauaacuuuaaaucuuuucuuc

SEQ ID NO: 5413 - RNA, 25 nt, Artificial Sequence
  Description of Artificial Sequence: Synthetic oligonucleotide
uaaaucuuuucuucaacuugagucu

SEQ ID NO: 5414 - RNA, 25 nt, Artificial Sequence
  Description of Artificial Sequence: Synthetic oligonucleotide
aaaucuuuucuucaacuugagucuu

SEQ ID NO: 5415 - RNA, 25 nt, Artificial Sequence
  Description of Artificial Sequence: Synthetic oligonucleotide
cuugagucuuugaagauaguuuuaa

SEQ ID NO: 5416 - RNA, 25 nt, Artificial Sequence
  Description of Artificial Sequence: Synthetic oligonucleotide
ugagucuuugaagauaguuuuaauu

SEQ ID NO: 5417 - RNA, 25 nt, Artificial Sequence
  Description of Artificial Sequence: Synthetic oligonucleotide
gagucuuugaagauaguuuuaauuc

SEQ ID NO: 5418 - RNA, 25 nt, Artificial Sequence
  Description of Artificial Sequence: Synthetic oligonucleotide
gauaguuuuaauucugcuugugaca

SEQ ID NO: 5419 - RNA, 25 nt, Artificial Sequence
  Description of Artificial Sequence: Synthetic oligonucleotide
auaguuuuaauucugcuugugacau

SEQ ID NO: 5420 - RNA, 25 nt, Artificial Sequence
  Description of Artificial Sequence: Synthetic oligonucleotide
uaguuuuaauucugcuugugacauu

SEQ ID NO: 5421 - RNA, 25 nt, Artificial Sequence
  Description of Artificial Sequence: Synthetic oligonucleotide
cuugugacauuaaaagauuauuugg

SEQ ID NO: 5422 - RNA, 25 nt, Artificial Sequence
  Description of Artificial Sequence: Synthetic oligonucleotide
cauugcuuuuguuucuuaagaaaac

SEQ ID NO: 5423 - RNA, 25 nt, Artificial Sequence
  Description of Artificial Sequence: Synthetic oligonucleotide
auugcuuuuguuucuuaagaaaaca

SEQ ID NO: 5424 - RNA, 25 nt, Artificial Sequence
  Description of Artificial Sequence: Synthetic oligonucleotide
uuuguuucuuaagaaaacaaacucu

SEQ ID NO: 5425 - RNA, 25 nt, Artificial Sequence
  Description of Artificial Sequence: Synthetic oligonucleotide
cuuaagaaaacaaacucuuuuuuaa

SEQ ID NO: 5426 - RNA, 25 nt, Artificial Sequence
  Description of Artificial Sequence: Synthetic oligonucleotide
uuaagaaaacaaacucuuuuuuaaa

SEQ ID NO: 5427 - RNA, 25 nt, Artificial Sequence
  Description of Artificial Sequence: Synthetic oligonucleotide
uaagaaaacaaacucuuuuuuaaaa

SEQ ID NO: 5428 - RNA, 25 nt, Artificial Sequence
  Description of Artificial Sequence: Synthetic oligonucleotide
aagaaaacaaacucuuuuuuaaaaa

SEQ ID NO: 5429 - RNA, 25 nt, Artificial Sequence
  Description of Artificial Sequence: Synthetic oligonucleotide
agaaaacaaacucuuuuuuaaaaau

SEQ ID NO: 5430 - RNA, 25 nt, Artificial Sequence
  Description of Artificial Sequence: Synthetic oligonucleotide
gaaaacaaacucuuuuuuaaaaauu

SEQ ID NO: 5431 - RNA, 25 nt, Artificial Sequence
  Description of Artificial Sequence: Synthetic oligonucleotide
aaaacaaacucuuuuuuaaaaauua

SEQ ID NO: 5432 - RNA, 25 nt, Artificial Sequence
  Description of Artificial Sequence: Synthetic oligonucleotide
caaacucuuuuuuaaaaauuacuuu

SEQ ID NO: 5433 - RNA, 25 nt, Artificial Sequence
  Description of Artificial Sequence: Synthetic oligonucleotide
cuuuuuuaaaaauuacuuuuaaaua

SEQ ID NO: 5434 - RNA, 25 nt, Artificial Sequence
  Description of Artificial Sequence: Synthetic oligonucleotide
uuuuuuaaaaauuacuuuuaaauau

SEQ ID NO: 5435 - RNA, 25 nt, Artificial Sequence
  Description of Artificial Sequence: Synthetic oligonucleotide
uuuuuaaaaauuacuuuuaaauauu

SEQ ID NO: 5436 - RNA, 25 nt, Artificial Sequence
  Description of Artificial Sequence: Synthetic oligonucleotide
uuuuaaaaauuacuuuuaaauauua

SEQ ID NO: 5437 - RNA, 25 nt, Artificial Sequence
  Description of Artificial Sequence: Synthetic oligonucleotide
uuuaaaaauuacuuuuaaauauuaa

SEQ ID NO: 5438 - RNA, 25 nt, Artificial Sequence
  Description of Artificial Sequence: Synthetic oligonucleotide
uuaaaaauuacuuuuaaauauuaac

SEQ ID NO: 5439 - RNA, 25 nt, Artificial Sequence
  Description of Artificial Sequence: Synthetic oligonucleotide
uaaaaauuacuuuuaaauauuaacu

SEQ ID NO: 5440 - RNA, 25 nt, Artificial Sequence
  Description of Artificial Sequence: Synthetic oligonucleotide
aaaaauuacuuuuaaauauuaacuc

SEQ ID NO: 5441 - RNA, 25 nt, Artificial Sequence
  Description of Artificial Sequence: Synthetic oligonucleotide
aaaauuacuuuuaaauauuaacuca

SEQ ID NO: 5442 - RNA, 25 nt, Artificial Sequence
  Description of Artificial Sequence: Synthetic oligonucleotide
cuuuuaaauauuaacucaaaaguug

SEQ ID NO: 5443 - RNA, 25 nt, Artificial Sequence
  Description of Artificial Sequence: Synthetic oligonucleotide
uuuuaaauauuaacucaaaaguuga

SEQ ID NO: 5444 - RNA, 25 nt, Artificial Sequence
  Description of Artificial Sequence: Synthetic oligonucleotide
uuaaauauuaacucaaaaguugaga

SEQ ID NO: 5445 - RNA, 25 nt, Artificial Sequence
  Description of Artificial Sequence: Synthetic oligonucleotide
aaauauuaacucaaaaguugagauu

SEQ ID NO: 5446 - RNA, 25 nt, Artificial Sequence
  Description of Artificial Sequence: Synthetic oligonucleotide
aauauuaacucaaaaguugagauuu

SEQ ID NO: 5447 - RNA, 25 nt, Artificial Sequence
  Description of Artificial Sequence: Synthetic oligonucleotide
auauuaacucaaaaguugagauuuu

SEQ ID NO: 5448 - RNA, 25 nt, Artificial Sequence
  Description of Artificial Sequence: Synthetic oligonucleotide
uauuaacucaaaaguugagauuuug

SEQ ID NO: 5449 - RNA, 25 nt, Artificial Sequence
  Description of Artificial Sequence: Synthetic oligonucleotide
ugugccaagacauuaauuuuuuuuu

SEQ ID NO: 5450 - RNA, 25 nt, Artificial Sequence
  Description of Artificial Sequence: Synthetic oligonucleotide
caagacauuaauuuuuuuuuuaaac

SEQ ID NO: 5451 - RNA, 25 nt, Artificial Sequence
  Description of Artificial Sequence: Synthetic oligonucleotide
aagacauuaauuuuuuuuuuaaaca

SEQ ID NO: 5452 - RNA, 25 nt, Artificial Sequence
  Description of Artificial Sequence: Synthetic oligonucleotide
uuaauuuuuuuuuuaaacaaugaag

SEQ ID NO: 5453 - RNA, 25 nt, Artificial Sequence
  Description of Artificial Sequence: Synthetic oligonucleotide
uaauuuuuuuuuuaaacaaugaagu

SEQ ID NO: 5454 - RNA, 25 nt, Artificial Sequence
  Description of Artificial Sequence: Synthetic oligonucleotide
auuuuuuuuuuaaacaaugaaguga

SEQ ID NO: 5455 - RNA, 25 nt, Artificial Sequence
  Description of Artificial Sequence: Synthetic oligonucleotide
uuuuuuuuuaaacaaugaagugaaa

SEQ ID NO: 5456 - RNA, 25 nt, Artificial Sequence
  Description of Artificial Sequence: Synthetic oligonucleotide
uuuuuuuuaaacaaugaagugaaaa

SEQ ID NO: 5457 - RNA, 25 nt, Artificial Sequence
  Description of Artificial Sequence: Synthetic oligonucleotide
uuuuuuuaaacaaugaagugaaaaa

SEQ ID NO: 5458 - RNA, 25 nt, Artificial Sequence
  Description of Artificial Sequence: Synthetic oligonucleotide
uuuuuuaaacaaugaagugaaaaag

SEQ ID NO: 5459 - RNA, 25 nt, Artificial Sequence
  Description of Artificial Sequence: Synthetic oligonucleotide
uuuuuaaacaaugaagugaaaaagu

SEQ ID NO: 5460 - RNA, 25 nt, Artificial Sequence
  Description of Artificial Sequence: Synthetic oligonucleotide
uuuaaacaaugaagugaaaaaguuu

SEQ ID NO: 5461 - RNA, 25 nt, Artificial Sequence
  Description of Artificial Sequence: Synthetic oligonucleotide
uuaaacaaugaagugaaaaaguuuu

SEQ ID NO: 5462 - RNA, 25 nt, Artificial Sequence
  Description of Artificial Sequence: Synthetic oligonucleotide
uaaacaaugaagugaaaaaguuuua

SEQ ID NO: 5463 - RNA, 25 nt, Artificial Sequence
  Description of Artificial Sequence: Synthetic oligonucleotide
gaagugaaaaaguuuuacaaucucu

SEQ ID NO: 5464 - RNA, 25 nt, Artificial Sequence
  Description of Artificial Sequence: Synthetic oligonucleotide
aaaaaguuuuacaaucucuagguuu

SEQ ID NO: 5465 - RNA, 25 nt, Artificial Sequence
  Description of Artificial Sequence: Synthetic oligonucleotide
aaaaguuuuacaaucucuagguuug

SEQ ID NO: 5466 - RNA, 25 nt, Artificial Sequence
  Description of Artificial Sequence: Synthetic oligonucleotide
aaaguuuuacaaucucuagguuugg

SEQ ID NO: 5467 - RNA, 25 nt, Artificial Sequence
  Description of Artificial Sequence: Synthetic oligonucleotide
ugguuaaauuaacauugcauaaaca

SEQ ID NO: 5468 - RNA, 25 nt, Artificial Sequence
  Description of Artificial Sequence: Synthetic oligonucleotide
gguuaaauuaacauugcauaaacac

SEQ ID NO: 5469 - RNA, 25 nt, Artificial Sequence
  Description of Artificial Sequence: Synthetic oligonucleotide
guuaaauuaacauugcauaaacacu

SEQ ID NO: 5470 - RNA, 25 nt, Artificial Sequence
  Description of Artificial Sequence: Synthetic oligonucleotide
auugcauaaacacuuuucaagucug

SEQ ID NO: 5471 - RNA, 25 nt, Artificial Sequence
  Description of Artificial Sequence: Synthetic oligonucleotide
aagucugauccauauuuaauaaugc

SEQ ID NO: 5472 - RNA, 25 nt, Artificial Sequence
  Description of Artificial Sequence: Synthetic oligonucleotide
cauauuuaauaaugcuuuaaaauaa

SEQ ID NO: 5473 - RNA, 25 nt, Artificial Sequence
  Description of Artificial Sequence: Synthetic oligonucleotide
auauuuaauaaugcuuuaaaauaaa

SEQ ID NO: 5474 - RNA, 25 nt, Artificial Sequence
  Description of Artificial Sequence: Synthetic oligonucleotide
uauuuaauaaugcuuuaaaauaaaa

SEQ ID NO: 5475 - RNA, 25 nt, Artificial Sequence
  Description of Artificial Sequence: Synthetic oligonucleotide
auuuaauaaugcuuuaaaauaaaaa

SEQ ID NO: 5476 - RNA, 25 nt, Artificial Sequence
  Description of Artificial Sequence: Synthetic oligonucleotide
uuuaauaaugcuuuaaaauaaaaau

SEQ ID NO: 5477 - RNA, 25 nt, Artificial Sequence
  Description of Artificial Sequence: Synthetic oligonucleotide
uuaauaaugcuuuaaaauaaaaaua

SEQ ID NO: 5478 - RNA, 25 nt, Artificial Sequence
  Description of Artificial Sequence: Synthetic oligonucleotide
aauaaugcuuuaaaauaaaaauaaa

SEQ ID NO: 5479 - RNA, 25 nt, Artificial Sequence
  Description of Artificial Sequence: Synthetic oligonucleotide
auaaugcuuuaaaauaaaaauaaaa

SEQ ID NO: 5480 - RNA, 25 nt, Artificial Sequence
  Description of Artificial Sequence: Synthetic oligonucleotide
uaaugcuuuaaaauaaaaauaaaaa

SEQ ID NO: 5481 - RNA, 25 nt, Artificial Sequence
  Description of Artificial Sequence: Synthetic oligonucleotide
aaugcuuuaaaauaaaaauaaaaac

SEQ ID NO: 5482 - RNA, 25 nt, Artificial Sequence
  Description of Artificial Sequence: Synthetic oligonucleotide
uaaaauaaaaauaaaaacaauccuu

SEQ ID NO: 5483 - RNA, 25 nt, Artificial Sequence
  Description of Artificial Sequence: Synthetic oligonucleotide
aaaaauaaaaacaauccuuuugaua

SEQ ID NO: 5484 - RNA, 25 nt, Artificial Sequence
  Description of Artificial Sequence: Synthetic oligonucleotide
aaaauaaaaacaauccuuuugauaa

SEQ ID NO: 5485 - RNA, 25 nt, Artificial Sequence
  Description of Artificial Sequence: Synthetic oligonucleotide
aaauaaaaacaauccuuuugauaaa

SEQ ID NO: 5486 - RNA, 25 nt, Artificial Sequence
  Description of Artificial Sequence: Synthetic oligonucleotide
aauaaaaacaauccuuuugauaaau

SEQ ID NO: 5487 - RNA, 25 nt, Artificial Sequence
  Description of Artificial Sequence: Synthetic oligonucleotide
auaaaaacaauccuuuugauaaauu

SEQ ID NO: 5488 - RNA, 25 nt, Artificial Sequence
  Description of Artificial Sequence: Synthetic oligonucleotide
uaaaaacaauccuuuugauaaauuu

SEQ ID NO: 5489 - RNA, 25 nt, Artificial Sequence
  Description of Artificial Sequence: Synthetic oligonucleotide
aaaaacaauccuuuugauaaauuua

SEQ ID NO: 5490 - RNA, 25 nt, Artificial Sequence
  Description of Artificial Sequence: Synthetic oligonucleotide
aaaacaauccuuuugauaaauuuaa

SEQ ID NO: 5491 - RNA, 25 nt, Artificial Sequence
  Description of Artificial Sequence: Synthetic oligonucleotide
caauccuuuugauaaauuuaaaaug

SEQ ID NO: 5492 - RNA, 25 nt, Artificial Sequence
  Description of Artificial Sequence: Synthetic oligonucleotide
cuuuugauaaauuuaaaauguuacu

SEQ ID NO: 5493 - RNA, 25 nt, Artificial Sequence
  Description of Artificial Sequence: Synthetic oligonucleotide
uuuugauaaauuuaaaauguuacuu

SEQ ID NO: 5494 - RNA, 25 nt, Artificial Sequence
  Description of Artificial Sequence: Synthetic oligonucleotide
uuugauaaauuuaaaauguuacuua

SEQ ID NO: 5495 - RNA, 25 nt, Artificial Sequence
  Description of Artificial Sequence: Synthetic oligonucleotide
auaaauuuaaaauguuacuuauuuu

SEQ ID NO: 5496 - RNA, 25 nt, Artificial Sequence
  Description of Artificial Sequence: Synthetic oligonucleotide
uaaauuuaaaauguuacuuauuuua

SEQ ID NO: 5497 - RNA, 25 nt, Artificial Sequence
  Description of Artificial Sequence: Synthetic oligonucleotide
aaauuuaaaauguuacuuauuuuaa

SEQ ID NO: 5498 - RNA, 25 nt, Artificial Sequence
  Description of Artificial Sequence: Synthetic oligonucleotide
aauuuaaaauguuacuuauuuuaaa

SEQ ID NO: 5499 - RNA, 25 nt, Artificial Sequence
  Description of Artificial Sequence: Synthetic oligonucleotide
auuuaaaauguuacuuauuuuaaaa

SEQ ID NO: 5500 - RNA, 25 nt, Artificial Sequence
  Description of Artificial Sequence: Synthetic oligonucleotide
uuuaaaauguuacuuauuuuaaaau

SEQ ID NO: 5501 - RNA, 25 nt, Artificial Sequence
  Description of Artificial Sequence: Synthetic oligonucleotide
uaaaauguuacuuauuuuaaaauaa

SEQ ID NO: 5502 - RNA, 25 nt, Artificial Sequence
  Description of Artificial Sequence: Synthetic oligonucleotide
aaaauguuacuuauuuuaaaauaaa

SEQ ID NO: 5503 - RNA, 25 nt, Artificial Sequence
  Description of Artificial Sequence: Synthetic oligonucleotide
aaauguuacuuauuuuaaaauaaau

SEQ ID NO: 5504 - RNA, 25 nt, Artificial Sequence
  Description of Artificial Sequence: Synthetic oligonucleotide
aauguuacuuauuuuaaaauaaaug

SEQ ID NO: 5505 - RNA, 25 nt, Artificial Sequence
  Description of Artificial Sequence: Synthetic oligonucleotide
auguuacuuauuuuaaaauaaauga

SEQ ID NO: 5506 - RNA, 25 nt, Artificial Sequence
  Description of Artificial Sequence: Synthetic oligonucleotide
guuacuuauuuuaaaauaaaugaag

SEQ ID NO: 5507 - RNA, 25 nt, Artificial Sequence
  Description of Artificial Sequence: Synthetic oligonucleotide
uuauuuuaaaauaaaugaagugaga

SEQ ID NO: 5508 - RNA, 25 nt, Artificial Sequence
  Description of Artificial Sequence: Synthetic oligonucleotide
auuuuaaaauaaaugaagugagaug

SEQ ID NO: 5509 - RNA, 25 nt, Artificial Sequence
  Description of Artificial Sequence: Synthetic oligonucleotide
uuuuaaaauaaaugaagugagaugg

SEQ ID NO: 5510 - RNA, 25 nt, Artificial Sequence
  Description of Artificial Sequence: Synthetic oligonucleotide
uaaaauaaaugaagugagauggcau

SEQ ID NO: 5511 - RNA, 25 nt, Artificial Sequence
  Description of Artificial Sequence: Synthetic oligonucleotide
aaaauaaaugaagugagauggcaug

SEQ ID NO: 5512 - RNA, 25 nt, Artificial Sequence
  Description of Artificial Sequence: Synthetic oligonucleotide
cauuucuucauguuaaaagaaguca

SEQ ID NO: 5513 - RNA, 25 nt, Artificial Sequence
  Description of Artificial Sequence: Synthetic oligonucleotide
auuucuucauguuaaaagaagucau

SEQ ID NO: 5514 - RNA, 25 nt, Artificial Sequence
  Description of Artificial Sequence: Synthetic oligonucleotide
caaacucuuaguuuuuuuuuuuuac

SEQ ID NO: 5515 - RNA, 25 nt, Artificial Sequence
  Description of Artificial Sequence: Synthetic oligonucleotide
guuuuuuuuuuuuacaacuauguaa

SEQ ID NO: 5516 - RNA, 25 nt, Artificial Sequence
  Description of Artificial Sequence: Synthetic oligonucleotide
uuuuuuuuuuuuacaacuauguaau

SEQ ID NO: 5517 - RNA, 25 nt, Artificial Sequence
  Description of Artificial Sequence: Synthetic oligonucleotide
uuuuuuuuuuuacaacuauguaauu

SEQ ID NO: 5518 - RNA, 25 nt, Artificial Sequence
  Description of Artificial Sequence: Synthetic oligonucleotide
uuuuuuuuuuacaacuauguaauuu

SEQ ID NO: 5519 - RNA, 25 nt, Artificial Sequence
  Description of Artificial Sequence: Synthetic oligonucleotide
uuuuuuuuuacaacuauguaauuua

SEQ ID NO: 5520 - RNA, 25 nt, Artificial Sequence
  Description of Artificial Sequence: Synthetic oligonucleotide
uuuuuuuuacaacuauguaauuuau

SEQ ID NO: 5521 - RNA, 25 nt, Artificial Sequence
  Description of Artificial Sequence: Synthetic oligonucleotide
uuuuuuuacaacuauguaauuuaua

SEQ ID NO: 5522 - RNA, 25 nt, Artificial Sequence
  Description of Artificial Sequence: Synthetic oligonucleotide
uuuuuuacaacuauguaauuuauau

SEQ ID NO: 5523 - RNA, 25 nt, Artificial Sequence
  Description of Artificial Sequence: Synthetic oligonucleotide
uuuuuacaacuauguaauuuauauu

SEQ ID NO: 5524 - RNA, 25 nt, Artificial Sequence
  Description of Artificial Sequence: Synthetic oligonucleotide
uuuuacaacuauguaauuuauauuc

SEQ ID NO: 5525 - RNA, 25 nt, Artificial Sequence
  Description of Artificial Sequence: Synthetic oligonucleotide
uuuacaacuauguaauuuauauucc

SEQ ID NO: 5526 - RNA, 25 nt, Artificial Sequence
  Description of Artificial Sequence: Synthetic oligonucleotide
cuauguaauuuauauuccauuuaca

SEQ ID NO: 5527 - RNA, 25 nt, Artificial Sequence
  Description of Artificial Sequence: Synthetic oligonucleotide
uauguaauuuauauuccauuuacau

SEQ ID NO: 5528 - RNA, 25 nt, Artificial Sequence
  Description of Artificial Sequence: Synthetic oligonucleotide
auguaauuuauauuccauuuacaua

SEQ ID NO: 5529 - RNA, 25 nt, Artificial Sequence
  Description of Artificial Sequence: Synthetic oligonucleotide
uuuauauuccauuuacauaaggaua

SEQ ID NO: 5530 - RNA, 25 nt, Artificial Sequence
  Description of Artificial Sequence: Synthetic oligonucleotide
uuauauuccauuuacauaaggauac

SEQ ID NO: 5531 - RNA, 25 nt, Artificial Sequence
  Description of Artificial Sequence: Synthetic oligonucleotide
uauauuccauuuacauaaggauaca

SEQ ID NO: 5532 - RNA, 25 nt, Artificial Sequence
  Description of Artificial Sequence: Synthetic oligonucleotide
auauuccauuuacauaaggauacac

SEQ ID NO: 5533 - RNA, 25 nt, Artificial Sequence
  Description of Artificial Sequence: Synthetic oligonucleotide
cauaaggauacacuuauuugucaag

SEQ ID NO: 5534 - RNA, 25 nt, Artificial Sequence
  Description of Artificial Sequence: Synthetic oligonucleotide
aggauacacuuauuugucaagcuca

SEQ ID NO: 5535 - RNA, 25 nt, Artificial Sequence
  Description of Artificial Sequence: Synthetic oligonucleotide
cuguaaauuuuuaaccuauguuaca

SEQ ID NO: 5536 - RNA, 25 nt, Artificial Sequence
  Description of Artificial Sequence: Synthetic oligonucleotide
uguaaauuuuuaaccuauguuacac

SEQ ID NO: 5537 - RNA, 25 nt, Artificial Sequence
  Description of Artificial Sequence: Synthetic oligonucleotide
guaaauuuuuaaccuauguuacacc

SEQ ID NO: 5538 - RNA, 25 nt, Artificial Sequence
  Description of Artificial Sequence: Synthetic oligonucleotide
caagaggugaaguuuauauuugaau

SEQ ID NO: 5539 - RNA, 25 nt, Artificial Sequence
  Description of Artificial Sequence: Synthetic oligonucleotide
agaggugaaguuuauauuugaauau

SEQ ID NO: 5540 - RNA, 25 nt, Artificial Sequence
  Description of Artificial Sequence: Synthetic oligonucleotide
gaggugaaguuuauauuugaauauc

SEQ ID NO: 5541 - RNA, 25 nt, Artificial Sequence
  Description of Artificial Sequence: Synthetic oligonucleotide
ggugaaguuuauauuugaauaucca

SEQ ID NO: 5542 - RNA, 25 nt, Artificial Sequence
  Description of Artificial Sequence: Synthetic oligonucleotide
gugaaguuuauauuugaauauccau

SEQ ID NO: 5543 - RNA, 25 nt, Artificial Sequence
  Description of Artificial Sequence: Synthetic oligonucleotide
guuuauauuugaauauccauucucg

SEQ ID NO: 5544 - RNA, 25 nt, Artificial Sequence
  Description of Artificial Sequence: Synthetic oligonucleotide
uugaugcaguuuuaauacuuguaau

SEQ ID NO: 5545 - RNA, 25 nt, Artificial Sequence
  Description of Artificial Sequence: Synthetic oligonucleotide
gaugcaguuuuaauacuuguaauuc

SEQ ID NO: 5546 - RNA, 25 nt, Artificial Sequence
  Description of Artificial Sequence: Synthetic oligonucleotide
uuugaccuaaucacuaauuuucagg

SEQ ID NO: 5547 - RNA, 25 nt, Artificial Sequence
  Description of Artificial Sequence: Synthetic oligonucleotide
cuaaucacuaauuuucagguggugg

SEQ ID NO: 5548 - RNA, 25 nt, Artificial Sequence
  Description of Artificial Sequence: Synthetic oligonucleotide
guaggauuuuucaaaccugguauga

SEQ ID NO: 5549 - RNA, 25 nt, Artificial Sequence
  Description of Artificial Sequence: Synthetic oligonucleotide
uggaaggagaauuuaauaaagauag

SEQ ID NO: 5550 - RNA, 25 nt, Artificial Sequence
  Description of Artificial Sequence: Synthetic oligonucleotide
aaggagaauuuaauaaagauagugc

SEQ ID NO: 5551 - RNA, 25 nt, Artificial Sequence
  Description of Artificial Sequence: Synthetic oligonucleotide
ggagaauuuaauaaagauagugcug

SEQ ID NO: 5552 - RNA, 25 nt, Artificial Sequence
  Description of Artificial Sequence: Synthetic oligonucleotide
gagaauuuaauaaagauagugcuga

SEQ ID NO: 5553 - RNA, 25 nt, Artificial Sequence
  Description of Artificial Sequence: Synthetic oligonucleotide
auuuaauaaagauagugcugaaaga

SEQ ID NO: 5554 - RNA, 25 nt, Artificial Sequence
  Description of Artificial Sequence: Synthetic oligonucleotide
cuuagguaaucuauaacuaggacua

SEQ ID NO: 5555 - RNA, 25 nt, Artificial Sequence
  Description of Artificial Sequence: Synthetic oligonucleotide
uuagguaaucuauaacuaggacuac

SEQ ID NO: 5556 - RNA, 25 nt, Artificial Sequence
  Description of Artificial Sequence: Synthetic oligonucleotide
caguaauacauuccauuguuuuagu

SEQ ID NO: 5557 - RNA, 25 nt, Artificial Sequence
  Description of Artificial Sequence: Synthetic oligonucleotide
guaauacauuccauuguuuuaguaa

SEQ ID NO: 5558 - RNA, 25 nt, Artificial Sequence
  Description of Artificial Sequence: Synthetic oligonucleotide
uaauacauuccauuguuuuaguaac

SEQ ID NO: 5559 - RNA, 25 nt, Artificial Sequence
  Description of Artificial Sequence: Synthetic oligonucleotide
aauacauuccauuguuuuaguaacc

SEQ ID NO: 5560 - RNA, 25 nt, Artificial Sequence
  Description of Artificial Sequence: Synthetic oligonucleotide
auuguuuuaguaaccagaaaucuuc

SEQ ID NO: 5561 - RNA, 25 nt, Artificial Sequence
  Description of Artificial Sequence: Synthetic oligonucleotide
cagaaaucuucaugcaaugaaaaau

SEQ ID NO: 5562 - RNA, 25 nt, Artificial Sequence
  Description of Artificial Sequence: Synthetic oligonucleotide
caugcaaugaaaaauacuuuaauuc

SEQ ID NO: 5563 - RNA, 25 nt, Artificial Sequence
  Description of Artificial Sequence: Synthetic oligonucleotide
ugaaaaauacuuuaauucaugaagc

SEQ ID NO: 5564 - RNA, 25 nt, Artificial Sequence
  Description of Artificial Sequence: Synthetic oligonucleotide
aaaaauacuuuaauucaugaagcuu

SEQ ID NO: 5565 - RNA, 25 nt, Artificial Sequence
  Description of Artificial Sequence: Synthetic oligonucleotide
aaaauacuuuaauucaugaagcuua

SEQ ID NO: 5566 - RNA, 25 nt, Artificial Sequence
  Description of Artificial Sequence: Synthetic oligonucleotide
caugaagcuuacuuuuuuuuuuugg

SEQ ID NO: 5567 - RNA, 25 nt, Artificial Sequence
  Description of Artificial Sequence: Synthetic oligonucleotide
gaagcuuacuuuuuuuuuuuggugu

SEQ ID NO: 5568 - RNA, 25 nt, Artificial Sequence
  Description of Artificial Sequence: Synthetic oligonucleotide
cuuacuuuuuuuuuuuggugucaga

SEQ ID NO: 5569 - RNA, 25 nt, Artificial Sequence
  Description of Artificial Sequence: Synthetic oligonucleotide
cuuuuuuuuuuuggugucagagucu

SEQ ID NO: 5570 - RNA, 25 nt, Artificial Sequence
  Description of Artificial Sequence: Synthetic oligonucleotide
uuuuuuuuuuuggugucagagucuc

SEQ ID NO: 5571 - RNA, 25 nt, Artificial Sequence
  Description of Artificial Sequence: Synthetic oligonucleotide
cuaauuuuuguauuuuuaggagaga

SEQ ID NO: 5572 - RNA, 25 nt, Artificial Sequence
  Description of Artificial Sequence: Synthetic oligonucleotide
auuuuuguauuuuuaggagagacgg

SEQ ID NO: 5573 - RNA, 25 nt, Artificial Sequence
  Description of Artificial Sequence: Synthetic oligonucleotide
cauuuauucagcaaauauuuauuga

SEQ ID NO: 5574 - RNA, 25 nt, Artificial Sequence
  Description of Artificial Sequence: Synthetic oligonucleotide
uuuauucagcaaauauuuauugagu

SEQ ID NO: 5575 - RNA, 25 nt, Artificial Sequence
  Description of Artificial Sequence: Synthetic oligonucleotide
uauucagcaaauauuuauugagugc

SEQ ID NO: 5576 - RNA, 25 nt, Artificial Sequence
  Description of Artificial Sequence: Synthetic oligonucleotide
uuuuaguuuugcaaagaagggguuu

SEQ ID NO: 5577 - RNA, 25 nt, Artificial Sequence
  Description of Artificial Sequence: Synthetic oligonucleotide
cuauaauuguuuugcuacgauucca

SEQ ID NO: 5578 - RNA, 25 nt, Artificial Sequence
  Description of Artificial Sequence: Synthetic oligonucleotide
cuuuauguaaaucacuucauuguuu

SEQ ID NO: 5579 - RNA, 25 nt, Artificial Sequence
  Description of Artificial Sequence: Synthetic oligonucleotide
uuuauguaaaucacuucauuguuuu

SEQ ID NO: 5580 - RNA, 25 nt, Artificial Sequence
  Description of Artificial Sequence: Synthetic oligonucleotide
uuauguaaaucacuucauuguuuua

SEQ ID NO: 5581 - RNA, 25 nt, Artificial Sequence
  Description of Artificial Sequence: Synthetic oligonucleotide
uauguaaaucacuucauuguuuuaa

SEQ ID NO: 5582 - RNA, 25 nt, Artificial Sequence
  Description of Artificial Sequence: Synthetic oligonucleotide
auguaaaucacuucauuguuuuaaa

SEQ ID NO: 5583 - RNA, 25 nt, Artificial Sequence
  Description of Artificial Sequence: Synthetic oligonucleotide
uguaaaucacuucauuguuuuaaag

SEQ ID NO: 5584 - RNA, 25 nt, Artificial Sequence
  Description of Artificial Sequence: Synthetic oligonucleotide
guaaaucacuucauuguuuuaaagg

SEQ ID NO: 5585 - RNA, 25 nt, Artificial Sequence
  Description of Artificial Sequence: Synthetic oligonucleotide
uguuuuaaaggaauaaacuugauua

SEQ ID NO: 5586 - RNA, 25 nt, Artificial Sequence
  Description of Artificial Sequence: Synthetic oligonucleotide
guuuuaaaggaauaaacuugauuau

SEQ ID NO: 5587 - RNA, 25 nt, Artificial Sequence
  Description of Artificial Sequence: Synthetic oligonucleotide
uuaaaggaauaaacuugauuauauu

SEQ ID NO: 5588 - RNA, 25 nt, Artificial Sequence
  Description of Artificial Sequence: Synthetic oligonucleotide
uaaaggaauaaacuugauuauauug

SEQ ID NO: 5589 - RNA, 25 nt, Artificial Sequence
  Description of Artificial Sequence: Synthetic oligonucleotide
aaaggaauaaacuugauuauauugu

SEQ ID NO: 5590 - RNA, 25 nt, Artificial Sequence
  Description of Artificial Sequence: Synthetic oligonucleotide
aggaauaaacuugauuauauuguuu

SEQ ID NO: 5591 - RNA, 25 nt, Artificial Sequence
  Description of Artificial Sequence: Synthetic oligonucleotide
ggaauaaacuugauuauauuguuuu

SEQ ID NO: 5592 - RNA, 25 nt, Artificial Sequence
  Description of Artificial Sequence: Synthetic oligonucleotide
gaauaaacuugauuauauuguuuuu

SEQ ID NO: 5593 - RNA, 25 nt, Artificial Sequence
  Description of Artificial Sequence: Synthetic oligonucleotide
aauaaacuugauuauauuguuuuuu

SEQ ID NO: 5594 - RNA, 25 nt, Artificial Sequence
  Description of Artificial Sequence: Synthetic oligonucleotide
auaaacuugauuauauuguuuuuuu

SEQ ID NO: 5595 - RNA, 25 nt, Artificial Sequence
  Description of Artificial Sequence: Synthetic oligonucleotide
cuugauuauauuguuuuuuuauuug

SEQ ID NO: 5596 - RNA, 25 nt, Artificial Sequence
  Description of Artificial Sequence: Synthetic oligonucleotide
uugauuauauuguuuuuuuauuugg

SEQ ID NO: 5597 - RNA, 25 nt, Artificial Sequence
  Description of Artificial Sequence: Synthetic oligonucleotide
auuauauuguuuuuuuauuuggcau

SEQ ID NO: 5598 - RNA, 25 nt, Artificial Sequence
  Description of Artificial Sequence: Synthetic oligonucleotide
auuguuuuuuuauuuggcauaacug

SEQ ID NO: 5599 - RNA, 25 nt, Artificial Sequence
  Description of Artificial Sequence: Synthetic oligonucleotide
uuguuuuuuuauuuggcauaacugu

SEQ ID NO: 5600 - RNA, 25 nt, Artificial Sequence
  Description of Artificial Sequence: Synthetic oligonucleotide
uuuuuuauuuggcauaacugugauu

SEQ ID NO: 5601 - RNA, 25 nt, Artificial Sequence
  Description of Artificial Sequence: Synthetic oligonucleotide
uuuuuauuuggcauaacugugauuc

SEQ ID NO: 5602 - RNA, 25 nt, Artificial Sequence
  Description of Artificial Sequence: Synthetic oligonucleotide
auaacugugauucuuuuaggacaau

SEQ ID NO: 5603 - RNA, 25 nt, Artificial Sequence
  Description of Artificial Sequence: Synthetic oligonucleotide
ugugauucuuuuaggacaauuacug

SEQ ID NO: 5604 - RNA, 25 nt, Artificial Sequence
  Description of Artificial Sequence: Synthetic oligonucleotide
gugauucuuuuaggacaauuacugu

SEQ ID NO: 5605 - RNA, 25 nt, Artificial Sequence
  Description of Artificial Sequence: Synthetic oligonucleotide
uguaugucagauauucauauugacc

SEQ ID NO: 5606 - RNA, 25 nt, Artificial Sequence
  Description of Artificial Sequence: Synthetic oligonucleotide
guaugucagauauucauauugaccc

SEQ ID NO: 5607 - RNA, 25 nt, Artificial Sequence
  Description of Artificial Sequence: Synthetic oligonucleotide
aauguguaauauuccaguuuucucu

SEQ ID NO: 5608 - RNA, 25 nt, Artificial Sequence
  Description of Artificial Sequence: Synthetic oligonucleotide
uaaguaauuaaaauauacuuaaaaa

SEQ ID NO: 5609 - RNA, 25 nt, Artificial Sequence
  Description of Artificial Sequence: Synthetic oligonucleotide
aaguaauuaaaauauacuuaaaaau

SEQ ID NO: 5610 - RNA, 25 nt, Artificial Sequence
  Description of Artificial Sequence: Synthetic oligonucleotide
aguaauuaaaauauacuuaaaaauu

SEQ ID NO: 5611 - RNA, 25 nt, Artificial Sequence
  Description of Artificial Sequence: Synthetic oligonucleotide
guaauuaaaauauacuuaaaaauua

SEQ ID NO: 5612 - RNA, 25 nt, Artificial Sequence
  Description of Artificial Sequence: Synthetic oligonucleotide
uaauuaaaauauacuuaaaaauuaa

SEQ ID NO: 5613 - RNA, 25 nt, Artificial Sequence
  Description of Artificial Sequence: Synthetic oligonucleotide
aauuaaaauauacuuaaaaauuaau

SEQ ID NO: 5614 - RNA, 25 nt, Artificial Sequence
  Description of Artificial Sequence: Synthetic oligonucleotide
auuaaaauauacuuaaaaauuaaua

SEQ ID NO: 5615 - RNA, 25 nt, Artificial Sequence
  Description of Artificial Sequence: Synthetic oligonucleotide
uuaaaauauacuuaaaaauuaauag

SEQ ID NO: 5616 - RNA, 25 nt, Artificial Sequence
  Description of Artificial Sequence: Synthetic oligonucleotide
uaaaauauacuuaaaaauuaauagu

SEQ ID NO: 5617 - RNA, 25 nt, Artificial Sequence
  Description of Artificial Sequence: Synthetic oligonucleotide
aaauauacuuaaaaauuaauaguuu

SEQ ID NO: 5618 - RNA, 25 nt, Artificial Sequence
  Description of Artificial Sequence: Synthetic oligonucleotide
aauauacuuaaaaauuaauaguuuu

SEQ ID NO: 5619 - RNA, 25 nt, Artificial Sequence
  Description of Artificial Sequence: Synthetic oligonucleotide
auauacuuaaaaauuaauaguuuua

SEQ ID NO: 5620 - RNA, 25 nt, Artificial Sequence
  Description of Artificial Sequence: Synthetic oligonucleotide
uauacuuaaaaauuaauaguuuuau

SEQ ID NO: 5621 - RNA, 25 nt, Artificial Sequence
  Description of Artificial Sequence: Synthetic oligonucleotide
cuuaaaaauuaauaguuuuaucugg

SEQ ID NO: 5622 - RNA, 25 nt, Artificial Sequence
  Description of Artificial Sequence: Synthetic oligonucleotide
aaaauuaauaguuuuaucuggguac

SEQ ID NO: 5623 - RNA, 25 nt, Artificial Sequence
  Description of Artificial Sequence: Synthetic oligonucleotide
aaauuaauaguuuuaucuggguaca

SEQ ID NO: 5624 - RNA, 25 nt, Artificial Sequence
  Description of Artificial Sequence: Synthetic oligonucleotide
aauuaauaguuuuaucuggguacaa

SEQ ID NO: 5625 - RNA, 25 nt, Artificial Sequence
  Description of Artificial Sequence: Synthetic oligonucleotide
cuggguacaaauaaacaggugccug

SEQ ID NO: 5626 - RNA, 25 nt, Artificial Sequence
  Description of Artificial Sequence: Synthetic oligonucleotide
caaggaaacuucuauguaaaaauca

SEQ ID NO: 5627 - RNA, 25 nt, Artificial Sequence
  Description of Artificial Sequence: Synthetic oligonucleotide
aaggaaacuucuauguaaaaaucac

SEQ ID NO: 5628 - RNA, 25 nt, Artificial Sequence
  Description of Artificial Sequence: Synthetic oligonucleotide
aggaaacuucuauguaaaaaucacu

SEQ ID NO: 5629 - RNA, 25 nt, Artificial Sequence
  Description of Artificial Sequence: Synthetic oligonucleotide
cuauguaaaaaucacuaugauuucu

SEQ ID NO: 5630 - RNA, 25 nt, Artificial Sequence
  Description of Artificial Sequence: Synthetic oligonucleotide
uauguaaaaaucacuaugauuucug

SEQ ID NO: 5631 - RNA, 25 nt, Artificial Sequence
  Description of Artificial Sequence: Synthetic oligonucleotide
auguaaaaaucacuaugauuucuga

SEQ ID NO: 5632 - RNA, 25 nt, Artificial Sequence
  Description of Artificial Sequence: Synthetic oligonucleotide
aaaaaucacuaugauuucugaauug

SEQ ID NO: 5633 - RNA, 25 nt, Artificial Sequence
  Description of Artificial Sequence: Synthetic oligonucleotide
aaaaucacuaugauuucugaauugc

SEQ ID NO: 5634 - RNA, 25 nt, Artificial Sequence
  Description of Artificial Sequence: Synthetic oligonucleotide
augauuucugaauugcuaugugaaa

SEQ ID NO: 5635 - RNA, 25 nt, Artificial Sequence
  Description of Artificial Sequence: Synthetic oligonucleotide
ugauuucugaauugcuaugugaaac

SEQ ID NO: 5636 - RNA, 25 nt, Artificial Sequence
  Description of Artificial Sequence: Synthetic oligonucleotide
ugugaaacuacagaucuuuggaaca

SEQ ID NO: 5637 - RNA, 25 nt, Artificial Sequence
  Description of Artificial Sequence: Synthetic oligonucleotide
gugaaacuacagaucuuuggaacac

SEQ ID NO: 5638 - RNA, 25 nt, Artificial Sequence
  Description of Artificial Sequence: Synthetic oligonucleotide
gguguuaagacuuacacaguaccuc

SEQ ID NO: 5639 - RNA, 25 nt, Artificial Sequence
  Description of Artificial Sequence: Synthetic oligonucleotide
uaggccucuugaauuuuugauguag

SEQ ID NO: 5640 - RNA, 25 nt, Artificial Sequence
  Description of Artificial Sequence: Synthetic oligonucleotide
uugaauuuuugauguagaugggcau

SEQ ID NO: 5641 - RNA, 25 nt, Artificial Sequence
  Description of Artificial Sequence: Synthetic oligonucleotide
ugaauuuuugauguagaugggcauu

SEQ ID NO: 5642 - RNA, 25 nt, Artificial Sequence
  Description of Artificial Sequence: Synthetic oligonucleotide
gaugggcauuuuuuuaagguagugg

SEQ ID NO: 5643 - RNA, 25 nt, Artificial Sequence
  Description of Artificial Sequence: Synthetic oligonucleotide
cauuuuuuuaagguagugguuaauu

SEQ ID NO: 5644 - RNA, 25 nt, Artificial Sequence
  Description of Artificial Sequence: Synthetic oligonucleotide
guagugguuaauuaccuuuauguga

SEQ ID NO: 5645 - RNA, 25 nt, Artificial Sequence
  Description of Artificial Sequence: Synthetic oligonucleotide
agugguuaauuaccuuuaugugaac

SEQ ID NO: 5646 - RNA, 25 nt, Artificial Sequence
  Description of Artificial Sequence: Synthetic oligonucleotide
gugguuaauuaccuuuaugugaacu

SEQ ID NO: 5647 - RNA, 25 nt, Artificial Sequence
  Description of Artificial Sequence: Synthetic oligonucleotide
ugguuaauuaccuuuaugugaacuu

SEQ ID NO: 5648 - RNA, 25 nt, Artificial Sequence
  Description of Artificial Sequence: Synthetic oligonucleotide
gguuaauuaccuuuaugugaacuuu

SEQ ID NO: 5649 - RNA, 25 nt, Artificial Sequence
  Description of Artificial Sequence: Synthetic oligonucleotide
cuuuaugugaacuuugaaugguuua

SEQ ID NO: 5650 - RNA, 25 nt, Artificial Sequence
  Description of Artificial Sequence: Synthetic oligonucleotide
ugugaacuuugaaugguuuaacaaa

SEQ ID NO: 5651 - RNA, 25 nt, Artificial Sequence
  Description of Artificial Sequence: Synthetic oligonucleotide
cuuugaaugguuuaacaaaagauuu

SEQ ID NO: 5652 - RNA, 25 nt, Artificial Sequence
  Description of Artificial Sequence: Synthetic oligonucleotide
gaaugguuuaacaaaagauuuguuu

SEQ ID NO: 5653 - RNA, 25 nt, Artificial Sequence
  Description of Artificial Sequence: Synthetic oligonucleotide
aaugguuuaacaaaagauuuguuuu

SEQ ID NO: 5654 - RNA, 25 nt, Artificial Sequence
  Description of Artificial Sequence: Synthetic oligonucleotide
augguuuaacaaaagauuuguuuuu

SEQ ID NO: 5655 - RNA, 25 nt, Artificial Sequence
  Description of Artificial Sequence: Synthetic oligonucleotide
ugguuuaacaaaagauuuguuuuug

SEQ ID NO: 5656 - RNA, 25 nt, Artificial Sequence
  Description of Artificial Sequence: Synthetic oligonucleotide
gguuuaacaaaagauuuguuuuugu

SEQ ID NO: 5657 - RNA, 25 nt, Artificial Sequence
  Description of Artificial Sequence: Synthetic oligonucleotide
uuuaacaaaagauuuguuuuuguag

SEQ ID NO: 5658 - RNA, 25 nt, Artificial Sequence
  Description of Artificial Sequence: Synthetic oligonucleotide
uuaacaaaagauuuguuuuuguaga

SEQ ID NO: 5659 - RNA, 25 nt, Artificial Sequence
  Description of Artificial Sequence: Synthetic oligonucleotide
caaaagauuuguuuuuguagagauu

SEQ ID NO: 5660 - RNA, 25 nt, Artificial Sequence
  Description of Artificial Sequence: Synthetic oligonucleotide
aaaagauuuguuuuuguagagauuu

SEQ ID NO: 5661 - RNA, 25 nt, Artificial Sequence
  Description of Artificial Sequence: Synthetic oligonucleotide
aaagauuuguuuuuguagagauuuu

SEQ ID NO: 5662 - RNA, 25 nt, Artificial Sequence
  Description of Artificial Sequence: Synthetic oligonucleotide
agauuuguuuuuguagagauuuuaa

SEQ ID NO: 5663 - RNA, 25 nt, Artificial Sequence
  Description of Artificial Sequence: Synthetic oligonucleotide
gauuuguuuuuguagagauuuuaaa

SEQ ID NO: 5664 - RNA, 25 nt, Artificial Sequence
  Description of Artificial Sequence: Synthetic oligonucleotide
auuuguuuuuguagagauuuuaaag

SEQ ID NO: 5665 - RNA, 25 nt, Artificial Sequence
  Description of Artificial Sequence: Synthetic oligonucleotide
uuuguuuuuguagagauuuuaaagg

SEQ ID NO: 5666 - RNA, 25 nt, Artificial Sequence
  Description of Artificial Sequence: Synthetic oligonucleotide
uuuguagagauuuuaaagggggaga

SEQ ID NO: 5667 - RNA, 25 nt, Artificial Sequence
  Description of Artificial Sequence: Synthetic oligonucleotide
gggggagaauucuagaaauaaaugu

SEQ ID NO: 5668 - RNA, 25 nt, Artificial Sequence
  Description of Artificial Sequence: Synthetic oligonucleotide
gggagaauucuagaaauaaauguua

SEQ ID NO: 5669 - RNA, 25 nt, Artificial Sequence
  Description of Artificial Sequence: Synthetic oligonucleotide
ggagaauucuagaaauaaauguuac

SEQ ID NO: 5670 - RNA, 25 nt, Artificial Sequence
  Description of Artificial Sequence: Synthetic oligonucleotide
gagaauucuagaaauaaauguuacc

SEQ ID NO: 5671 - RNA, 25 nt, Artificial Sequence
  Description of Artificial Sequence: Synthetic oligonucleotide
agaauucuagaaauaaauguuaccu

SEQ ID NO: 5672 - RNA, 25 nt, Artificial Sequence
  Description of Artificial Sequence: Synthetic oligonucleotide
gaauucuagaaauaaauguuaccua

SEQ ID NO: 5673 - RNA, 25 nt, Artificial Sequence
  Description of Artificial Sequence: Synthetic oligonucleotide
cuagaaauaaauguuaccuaauuau

SEQ ID NO: 5674 - RNA, 25 nt, Artificial Sequence
  Description of Artificial Sequence: Synthetic oligonucleotide
uagaaauaaauguuaccuaauuauu

SEQ ID NO: 5675 - RNA, 25 nt, Artificial Sequence
  Description of Artificial Sequence: Synthetic oligonucleotide
agaaauaaauguuaccuaauuauua

SEQ ID NO: 5676 - RNA, 25 nt, Artificial Sequence
  Description of Artificial Sequence: Synthetic oligonucleotide
gaaauaaauguuaccuaauuauuac

SEQ ID NO: 5677 - RNA, 25 nt, Artificial Sequence
  Description of Artificial Sequence: Synthetic oligonucleotide
aaauaaauguuaccuaauuauuaca

SEQ ID NO: 5678 - RNA, 25 nt, Artificial Sequence
  Description of Artificial Sequence: Synthetic oligonucleotide
auaaauguuaccuaauuauuacagc

SEQ ID NO: 5679 - RNA, 25 nt, Artificial Sequence
  Description of Artificial Sequence: Synthetic oligonucleotide
cuaauuauuacagccuuaaagacaa

SEQ ID NO: 5680 - RNA, 25 nt, Artificial Sequence
  Description of Artificial Sequence: Synthetic oligonucleotide
uaauuauuacagccuuaaagacaaa

SEQ ID NO: 5681 - RNA, 25 nt, Artificial Sequence
  Description of Artificial Sequence: Synthetic oligonucleotide
uuaaagacaaaaauccuuguugaag

SEQ ID NO: 5682 - RNA, 25 nt, Artificial Sequence
  Description of Artificial Sequence: Synthetic oligonucleotide
aagacaaaaauccuuguugaaguuu

SEQ ID NO: 5683 - RNA, 25 nt, Artificial Sequence
  Description of Artificial Sequence: Synthetic oligonucleotide
cuuguugaaguuuuuuuaaaaaaag

SEQ ID NO: 5684 - RNA, 25 nt, Artificial Sequence
  Description of Artificial Sequence: Synthetic oligonucleotide
uuguugaaguuuuuuuaaaaaaagc

SEQ ID NO: 5685 - RNA, 25 nt, Artificial Sequence
  Description of Artificial Sequence: Synthetic oligonucleotide
guugaaguuuuuuuaaaaaaagcua

SEQ ID NO: 5686 - RNA, 25 nt, Artificial Sequence
  Description of Artificial Sequence: Synthetic oligonucleotide
uugaaguuuuuuuaaaaaaagcuaa

SEQ ID NO: 5687 - RNA, 25 nt, Artificial Sequence
  Description of Artificial Sequence: Synthetic oligonucleotide
aguuuuuuuaaaaaaagcuaaauua

SEQ ID NO: 5688 - RNA, 25 nt, Artificial Sequence
  Description of Artificial Sequence: Synthetic oligonucleotide
guuuuuuuaaaaaaagcuaaauuac

SEQ ID NO: 5689 - RNA, 25 nt, Artificial Sequence
  Description of Artificial Sequence: Synthetic oligonucleotide
uuuuuuuaaaaaaagcuaaauuaca

SEQ ID NO: 5690 - RNA, 25 nt, Artificial Sequence
  Description of Artificial Sequence: Synthetic oligonucleotide
uuuuuuaaaaaaagcuaaauuacau

SEQ ID NO: 5691 - RNA, 25 nt, Artificial Sequence
  Description of Artificial Sequence: Synthetic oligonucleotide
uuuuuaaaaaaagcuaaauuacaua

SEQ ID NO: 5692 - RNA, 25 nt, Artificial Sequence
  Description of Artificial Sequence: Synthetic oligonucleotide
uaaaaaaagcuaaauuacauagacu

SEQ ID NO: 5693 - RNA, 25 nt, Artificial Sequence
  Description of Artificial Sequence: Synthetic oligonucleotide
aaaaaagcuaaauuacauagacuua

SEQ ID NO: 5694 - RNA, 25 nt, Artificial Sequence
  Description of Artificial Sequence: Synthetic oligonucleotide
uuaggcauuaacauguuuguggaag

SEQ ID NO: 5695 - RNA, 25 nt, Artificial Sequence
  Description of Artificial Sequence: Synthetic oligonucleotide
uaggcauuaacauguuuguggaaga

SEQ ID NO: 5696 - RNA, 25 nt, Artificial Sequence
  Description of Artificial Sequence: Synthetic oligonucleotide
cagacguauauuguaucauuugagu

SEQ ID NO: 5697 - RNA, 25 nt, Artificial Sequence
  Description of Artificial Sequence: Synthetic oligonucleotide
cguauauuguaucauuugagugaau

SEQ ID NO: 5698 - RNA, 25 nt, Artificial Sequence
  Description of Artificial Sequence: Synthetic oligonucleotide
uauauuguaucauuugagugaaugu

SEQ ID NO: 5699 - RNA, 25 nt, Artificial Sequence
  Description of Artificial Sequence: Synthetic oligonucleotide
auuguaucauuugagugaauguucc

SEQ ID NO: 5700 - RNA, 25 nt, Artificial Sequence
  Description of Artificial Sequence: Synthetic oligonucleotide
uuguaucauuugagugaauguuccc

SEQ ID NO: 5701 - RNA, 25 nt, Artificial Sequence
  Description of Artificial Sequence: Synthetic oligonucleotide
uguaucauuugagugaauguuccca

SEQ ID NO: 5702 - RNA, 25 nt, Artificial Sequence
  Description of Artificial Sequence: Synthetic oligonucleotide
aggaauuuagaaccuaacuuuuaua

SEQ ID NO: 5703 - RNA, 25 nt, Artificial Sequence
  Description of Artificial Sequence: Synthetic oligonucleotide
ggaauuuagaaccuaacuuuuauag

SEQ ID NO: 5704 - RNA, 25 nt, Artificial Sequence
  Description of Artificial Sequence: Synthetic oligonucleotide
uuuagaaccuaacuuuuauagguua

SEQ ID NO: 5705 - RNA, 25 nt, Artificial Sequence
  Description of Artificial Sequence: Synthetic oligonucleotide
uuagaaccuaacuuuuauagguuau

SEQ ID NO: 5706 - RNA, 25 nt, Artificial Sequence
  Description of Artificial Sequence: Synthetic oligonucleotide
uagaaccuaacuuuuauagguuauc

SEQ ID NO: 5707 - RNA, 25 nt, Artificial Sequence
  Description of Artificial Sequence: Synthetic oligonucleotide
agaaccuaacuuuuauagguuauca

SEQ ID NO: 5708 - RNA, 25 nt, Artificial Sequence
  Description of Artificial Sequence: Synthetic oligonucleotide
uuauagguuaucaaaacuguuguca

SEQ ID NO: 5709 - RNA, 25 nt, Artificial Sequence
  Description of Artificial Sequence: Synthetic oligonucleotide
auagguuaucaaaacuguugucacc

SEQ ID NO: 5710 - RNA, 25 nt, Artificial Sequence
  Description of Artificial Sequence: Synthetic oligonucleotide
uuuuguccuaauauauacauagaaa

SEQ ID NO: 5711 - RNA, 25 nt, Artificial Sequence
  Description of Artificial Sequence: Synthetic oligonucleotide
uuuguccuaauauauacauagaaac

SEQ ID NO: 5712 - RNA, 25 nt, Artificial Sequence
  Description of Artificial Sequence: Synthetic oligonucleotide
uuguccuaauauauacauagaaacu

SEQ ID NO: 5713 - RNA, 25 nt, Artificial Sequence
  Description of Artificial Sequence: Synthetic oligonucleotide
uaauauauacauagaaacuuugugg

SEQ ID NO: 5714 - RNA, 25 nt, Artificial Sequence
  Description of Artificial Sequence: Synthetic oligonucleotide
uauacauagaaacuuuguggggcau

SEQ ID NO: 5715 - RNA, 25 nt, Artificial Sequence
  Description of Artificial Sequence: Synthetic oligonucleotide
caaguucaucucauuuguauuccau

SEQ ID NO: 5716 - RNA, 25 nt, Artificial Sequence
  Description of Artificial Sequence: Synthetic oligonucleotide
cauuuguauuccauugauuuuuuuu

SEQ ID NO: 5717 - RNA, 25 nt, Artificial Sequence
  Description of Artificial Sequence: Synthetic oligonucleotide
auuuguauuccauugauuuuuuuuu

SEQ ID NO: 5718 - RNA, 25 nt, Artificial Sequence
  Description of Artificial Sequence: Synthetic oligonucleotide
uuuguauuccauugauuuuuuuuuu

SEQ ID NO: 5719 - RNA, 25 nt, Artificial Sequence
  Description of Artificial Sequence: Synthetic oligonucleotide
uuguauuccauugauuuuuuuuuuc

SEQ ID NO: 5720 - RNA, 25 nt, Artificial Sequence
  Description of Artificial Sequence: Synthetic oligonucleotide
uguauuccauugauuuuuuuuuucu

SEQ ID NO: 5721 - RNA, 25 nt, Artificial Sequence
  Description of Artificial Sequence: Synthetic oligonucleotide
guauuccauugauuuuuuuuuucuu

SEQ ID NO: 5722 - RNA, 25 nt, Artificial Sequence
  Description of Artificial Sequence: Synthetic oligonucleotide
uauuccauugauuuuuuuuuucuuc

SEQ ID NO: 5723 - RNA, 25 nt, Artificial Sequence
  Description of Artificial Sequence: Synthetic oligonucleotide
uugauuuuuuuuuucuucuaaacau

SEQ ID NO: 5724 - RNA, 25 nt, Artificial Sequence
  Description of Artificial Sequence: Synthetic oligonucleotide
ugauuuuuuuuuucuucuaaacauu

SEQ ID NO: 5725 - RNA, 25 nt, Artificial Sequence
  Description of Artificial Sequence: Synthetic oligonucleotide
uuuuuuuuucuucuaaacauuuuuu

SEQ ID NO: 5726 - RNA, 25 nt, Artificial Sequence
  Description of Artificial Sequence: Synthetic oligonucleotide
uuuuuuuucuucuaaacauuuuuuc

SEQ ID NO: 5727 - RNA, 25 nt, Artificial Sequence
  Description of Artificial Sequence: Synthetic oligonucleotide
uuuuuuucuucuaaacauuuuuucu

SEQ ID NO: 5728 - RNA, 25 nt, Artificial Sequence
  Description of Artificial Sequence: Synthetic oligonucleotide
uuuuuucuucuaaacauuuuuucuu

SEQ ID NO: 5729 - RNA, 25 nt, Artificial Sequence
  Description of Artificial Sequence: Synthetic oligonucleotide
uuuuucuucuaaacauuuuuucuuc

SEQ ID NO: 5730 - RNA, 25 nt, Artificial Sequence
  Description of Artificial Sequence: Synthetic oligonucleotide
cauuuuuucuucaaacaguauauaa

SEQ ID NO: 5731 - RNA, 25 nt, Artificial Sequence
  Description of Artificial Sequence: Synthetic oligonucleotide
auuuuuucuucaaacaguauauaac

SEQ ID NO: 5732 - RNA, 25 nt, Artificial Sequence
  Description of Artificial Sequence: Synthetic oligonucleotide
uuuuuucuucaaacaguauauaacu

SEQ ID NO: 5733 - RNA, 25 nt, Artificial Sequence
  Description of Artificial Sequence: Synthetic oligonucleotide
uuuuucuucaaacaguauauaacuu

SEQ ID NO: 5734 - RNA, 25 nt, Artificial Sequence
  Description of Artificial Sequence: Synthetic oligonucleotide
uuuucuucaaacaguauauaacuuu

SEQ ID NO: 5735 - RNA, 25 nt, Artificial Sequence
  Description of Artificial Sequence: Synthetic oligonucleotide
caaacaguauauaacuuuuuuuagg

SEQ ID NO: 5736 - RNA, 25 nt, Artificial Sequence
  Description of Artificial Sequence: Synthetic oligonucleotide
aguauauaacuuuuuuuaggggauu

SEQ ID NO: 5737 - RNA, 25 nt, Artificial Sequence
  Description of Artificial Sequence: Synthetic oligonucleotide
guauauaacuuuuuuuaggggauuu

SEQ ID NO: 5738 - RNA, 25 nt, Artificial Sequence
  Description of Artificial Sequence: Synthetic oligonucleotide
uauauaacuuuuuuuaggggauuuu

SEQ ID NO: 5739 - RNA, 25 nt, Artificial Sequence
  Description of Artificial Sequence: Synthetic oligonucleotide
auauaacuuuuuuuaggggauuuuu

SEQ ID NO: 5740 - RNA, 25 nt, Artificial Sequence
  Description of Artificial Sequence: Synthetic oligonucleotide
cuuuuuuuaggggauuuuuuuuuag

SEQ ID NO: 5741 - RNA, 25 nt, Artificial Sequence
  Description of Artificial Sequence: Synthetic oligonucleotide
uuuuuuuaggggauuuuuuuuuaga

SEQ ID NO: 5742 - RNA, 25 nt, Artificial Sequence
  Description of Artificial Sequence: Synthetic oligonucleotide
gauuuuuuuuuagacagcaaaaacu

SEQ ID NO: 5743 - RNA, 25 nt, Artificial Sequence
  Description of Artificial Sequence: Synthetic oligonucleotide
auuuuuuuuuagacagcaaaaacua

SEQ ID NO: 5744 - RNA, 25 nt, Artificial Sequence
  Description of Artificial Sequence: Synthetic oligonucleotide
uuuuuuuuuagacagcaaaaacuau

SEQ ID NO: 5745 - RNA, 25 nt, Artificial Sequence
  Description of Artificial Sequence: Synthetic oligonucleotide
aagauuuccauuugucaaaaaguaa

SEQ ID NO: 5746 - RNA, 25 nt, Artificial Sequence
  Description of Artificial Sequence: Synthetic oligonucleotide
agauuuccauuugucaaaaaguaau

SEQ ID NO: 5747 - RNA, 25 nt, Artificial Sequence
  Description of Artificial Sequence: Synthetic oligonucleotide
gauuuccauuugucaaaaaguaaug

SEQ ID NO: 5748 - RNA, 25 nt, Artificial Sequence
  Description of Artificial Sequence: Synthetic oligonucleotide
auuuccauuugucaaaaaguaauga

SEQ ID NO: 5749 - RNA, 25 nt, Artificial Sequence
  Description of Artificial Sequence: Synthetic oligonucleotide
cauuugucaaaaaguaaugauuucu

SEQ ID NO: 5750 - RNA, 25 nt, Artificial Sequence
  Description of Artificial Sequence: Synthetic oligonucleotide
auuugucaaaaaguaaugauuucuu

SEQ ID NO: 5751 - RNA, 25 nt, Artificial Sequence
  Description of Artificial Sequence: Synthetic oligonucleotide
uuugucaaaaaguaaugauuucuug

SEQ ID NO: 5752 - RNA, 25 nt, Artificial Sequence
  Description of Artificial Sequence: Synthetic oligonucleotide
caaaaaguaaugauuucuugauaau

SEQ ID NO: 5753 - RNA, 25 nt, Artificial Sequence
  Description of Artificial Sequence: Synthetic oligonucleotide
aaaaaguaaugauuucuugauaauu

SEQ ID NO: 5754 - RNA, 25 nt, Artificial Sequence
  Description of Artificial Sequence: Synthetic oligonucleotide
aaaaguaaugauuucuugauaauug

SEQ ID NO: 5755 - RNA, 25 nt, Artificial Sequence
  Description of Artificial Sequence: Synthetic oligonucleotide
aaaguaaugauuucuugauaauugu

SEQ ID NO: 5756 - RNA, 25 nt, Artificial Sequence
  Description of Artificial Sequence: Synthetic oligonucleotide
aguaaugauuucuugauaauugugu

SEQ ID NO: 5757 - RNA, 25 nt, Artificial Sequence
  Description of Artificial Sequence: Synthetic oligonucleotide
uaaugauuucuugauaauuguguag

SEQ ID NO: 5758 - RNA, 25 nt, Artificial Sequence
  Description of Artificial Sequence: Synthetic oligonucleotide
aaugauuucuugauaauuguguagu

SEQ ID NO: 5759 - RNA, 25 nt, Artificial Sequence
  Description of Artificial Sequence: Synthetic oligonucleotide
ugauuucuugauaauuguguaguaa

SEQ ID NO: 5760 - RNA, 25 nt, Artificial Sequence
  Description of Artificial Sequence: Synthetic oligonucleotide
gauuucuugauaauuguguaguaau

SEQ ID NO: 5761 - RNA, 25 nt, Artificial Sequence
  Description of Artificial Sequence: Synthetic oligonucleotide
cuugauaauuguguaguaauguuuu

SEQ ID NO: 5762 - RNA, 25 nt, Artificial Sequence
  Description of Artificial Sequence: Synthetic oligonucleotide
uugauaauuguguaguaauguuuuu

SEQ ID NO: 5763 - RNA, 25 nt, Artificial Sequence
  Description of Artificial Sequence: Synthetic oligonucleotide
ugauaauuguguaguaauguuuuuu

SEQ ID NO: 5764 - RNA, 25 nt, Artificial Sequence
  Description of Artificial Sequence: Synthetic oligonucleotide
auaauuguguaguaauguuuuuuag

SEQ ID NO: 5765 - RNA, 25 nt, Artificial Sequence
  Description of Artificial Sequence: Synthetic oligonucleotide
auuguguaguaauguuuuuuagaac

SEQ ID NO: 5766 - RNA, 25 nt, Artificial Sequence
  Description of Artificial Sequence: Synthetic oligonucleotide
uguguaguaauguuuuuuagaaccc

SEQ ID NO: 5767 - RNA, 25 nt, Artificial Sequence
  Description of Artificial Sequence: Synthetic oligonucleotide
guguaguaauguuuuuuagaaccca

SEQ ID NO: 5768 - RNA, 25 nt, Artificial Sequence
  Description of Artificial Sequence: Synthetic oligonucleotide
uuaaagcugaauuuauauuuaguaa

SEQ ID NO: 5769 - RNA, 25 nt, Artificial Sequence
  Description of Artificial Sequence: Synthetic oligonucleotide
aaagcugaauuuauauuuaguaacu

SEQ ID NO: 5770 - RNA, 25 nt, Artificial Sequence
  Description of Artificial Sequence: Synthetic oligonucleotide
uuuauauuuaguaacuucuguguua

SEQ ID NO: 5771 - RNA, 25 nt, Artificial Sequence
  Description of Artificial Sequence: Synthetic oligonucleotide
uuauauuuaguaacuucuguguuaa

SEQ ID NO: 5772 - RNA, 25 nt, Artificial Sequence
  Description of Artificial Sequence: Synthetic oligonucleotide
uauauuuaguaacuucuguguuaau

SEQ ID NO: 5773 - RNA, 25 nt, Artificial Sequence
  Description of Artificial Sequence: Synthetic oligonucleotide
uuaguaacuucuguguuaauacugg

SEQ ID NO: 5774 - RNA, 25 nt, Artificial Sequence
  Description of Artificial Sequence: Synthetic oligonucleotide
ugaauagcugucauaaaaugaaacu

SEQ ID NO: 5775 - RNA, 25 nt, Artificial Sequence
  Description of Artificial Sequence: Synthetic oligonucleotide
gaauagcugucauaaaaugaaacuu

SEQ ID NO: 5776 - RNA, 25 nt, Artificial Sequence
  Description of Artificial Sequence: Synthetic oligonucleotide
aaaugaaacuuucuuucuaaagaaa

SEQ ID NO: 5777 - RNA, 25 nt, Artificial Sequence
  Description of Artificial Sequence: Synthetic oligonucleotide
aaugaaacuuucuuucuaaagaaag

SEQ ID NO: 5778 - RNA, 25 nt, Artificial Sequence
  Description of Artificial Sequence: Synthetic oligonucleotide
augaaacuuucuuucuaaagaaaga

SEQ ID NO: 5779 - RNA, 25 nt, Artificial Sequence
  Description of Artificial Sequence: Synthetic oligonucleotide
gaaacuuucuuucuaaagaaagaua

SEQ ID NO: 5780 - RNA, 25 nt, Artificial Sequence
  Description of Artificial Sequence: Synthetic oligonucleotide
cuuucuuucuaaagaaagauacuca

SEQ ID NO: 5781 - RNA, 25 nt, Artificial Sequence
  Description of Artificial Sequence: Synthetic oligonucleotide
caugaguucuugaagaauagucaua

SEQ ID NO: 5782 - RNA, 25 nt, Artificial Sequence
  Description of Artificial Sequence: Synthetic oligonucleotide
uugaagaauagucauaacuagauua

SEQ ID NO: 5783 - RNA, 25 nt, Artificial Sequence
  Description of Artificial Sequence: Synthetic oligonucleotide
ugaagaauagucauaacuagauuaa

SEQ ID NO: 5784 - RNA, 25 nt, Artificial Sequence
  Description of Artificial Sequence: Synthetic oligonucleotide
gaagaauagucauaacuagauuaag

SEQ ID NO: 5785 - RNA, 25 nt, Artificial Sequence
  Description of Artificial Sequence: Synthetic oligonucleotide
gaauagucauaacuagauuaagauc

SEQ ID NO: 5786 - RNA, 25 nt, Artificial Sequence
  Description of Artificial Sequence: Synthetic oligonucleotide
aauagucauaacuagauuaagaucu

SEQ ID NO: 5787 - RNA, 25 nt, Artificial Sequence
  Description of Artificial Sequence: Synthetic oligonucleotide
auagucauaacuagauuaagaucug

SEQ ID NO: 5788 - RNA, 25 nt, Artificial Sequence
  Description of Artificial Sequence: Synthetic oligonucleotide
uagucauaacuagauuaagaucugu

SEQ ID NO: 5789 - RNA, 25 nt, Artificial Sequence
  Description of Artificial Sequence: Synthetic oligonucleotide
cauaacuagauuaagaucuguguuu

SEQ ID NO: 5790 - RNA, 25 nt, Artificial Sequence
  Description of Artificial Sequence: Synthetic oligonucleotide
uagauuaagaucuguguuuuaguuu

SEQ ID NO: 5791 - RNA, 25 nt, Artificial Sequence
  Description of Artificial Sequence: Synthetic oligonucleotide
gauuaagaucuguguuuuaguuuaa

SEQ ID NO: 5792 - RNA, 25 nt, Artificial Sequence
  Description of Artificial Sequence: Synthetic oligonucleotide
auuaagaucuguguuuuaguuuaau

SEQ ID NO: 5793 - RNA, 25 nt, Artificial Sequence
  Description of Artificial Sequence: Synthetic oligonucleotide
uaagaucuguguuuuaguuuaauag

SEQ ID NO: 5794 - RNA, 25 nt, Artificial Sequence
  Description of Artificial Sequence: Synthetic oligonucleotide
uguguuuuaguuuaauaguuugaag

SEQ ID NO: 5795 - RNA, 25 nt, Artificial Sequence
  Description of Artificial Sequence: Synthetic oligonucleotide
guguuuuaguuuaauaguuugaagu

SEQ ID NO: 5796 - RNA, 25 nt, Artificial Sequence
  Description of Artificial Sequence: Synthetic oligonucleotide
guuuuaguuuaauaguuugaagugc

SEQ ID NO: 5797 - RNA, 25 nt, Artificial Sequence
  Description of Artificial Sequence: Synthetic oligonucleotide
uuuaguuuaauaguuugaagugccu

SEQ ID NO: 5798 - RNA, 25 nt, Artificial Sequence
  Description of Artificial Sequence: Synthetic oligonucleotide
uuaguuuaauaguuugaagugccug

SEQ ID NO: 5799 - RNA, 25 nt, Artificial Sequence
  Description of Artificial Sequence: Synthetic oligonucleotide
uugggauaaugauagguaauuuaga

SEQ ID NO: 5800 - RNA, 25 nt, Artificial Sequence
  Description of Artificial Sequence: Synthetic oligonucleotide
gggauaaugauagguaauuuagaug

SEQ ID NO: 5801 - RNA, 25 nt, Artificial Sequence
  Description of Artificial Sequence: Synthetic oligonucleotide
auaaugauagguaauuuagaugaau

SEQ ID NO: 5802 - RNA, 25 nt, Artificial Sequence
  Description of Artificial Sequence: Synthetic oligonucleotide
uaaugauagguaauuuagaugaauu

SEQ ID NO: 5803 - RNA, 25 nt, Artificial Sequence
  Description of Artificial Sequence: Synthetic oligonucleotide
ugauagguaauuuagaugaauuuag

SEQ ID NO: 5804 - RNA, 25 nt, Artificial Sequence
  Description of Artificial Sequence: Synthetic oligonucleotide
gauagguaauuuagaugaauuuagg

SEQ ID NO: 5805 - RNA, 25 nt, Artificial Sequence
  Description of Artificial Sequence: Synthetic oligonucleotide
guaauuuagaugaauuuaggggaaa

SEQ ID NO: 5806 - RNA, 25 nt, Artificial Sequence
  Description of Artificial Sequence: Synthetic oligonucleotide
aauuuagaugaauuuaggggaaaaa

SEQ ID NO: 5807 - RNA, 25 nt, Artificial Sequence
  Description of Artificial Sequence: Synthetic oligonucleotide
augaauuuaggggaaaaaaaaguua

SEQ ID NO: 5808 - RNA, 25 nt, Artificial Sequence
  Description of Artificial Sequence: Synthetic oligonucleotide
ugaauuuaggggaaaaaaaaguuau

SEQ ID NO: 5809 - RNA, 25 nt, Artificial Sequence
  Description of Artificial Sequence: Synthetic oligonucleotide
gaaaaaaaaguuaucugcagauaug

SEQ ID NO: 5810 - RNA, 25 nt, Artificial Sequence
  Description of Artificial Sequence: Synthetic oligonucleotide
aaaaaaaaguuaucugcagauaugu

SEQ ID NO: 5811 - RNA, 25 nt, Artificial Sequence
  Description of Artificial Sequence: Synthetic oligonucleotide
aaaguuaucugcagauauguugagg

SEQ ID NO: 5812 - RNA, 25 nt, Artificial Sequence
  Description of Artificial Sequence: Synthetic oligonucleotide
cuuguguuuucauguugaaaauacu

SEQ ID NO: 5813 - RNA, 25 nt, Artificial Sequence
  Description of Artificial Sequence: Synthetic oligonucleotide
uuguguuuucauguugaaaauacuu

SEQ ID NO: 5814 - RNA, 25 nt, Artificial Sequence
  Description of Artificial Sequence: Synthetic oligonucleotide
uguguuuucauguugaaaauacuuu

SEQ ID NO: 5815 - RNA, 25 nt, Artificial Sequence
  Description of Artificial Sequence: Synthetic oligonucleotide
uguugaaaauacuuuugcauuuuuc

SEQ ID NO: 5816 - RNA, 25 nt, Artificial Sequence
  Description of Artificial Sequence: Synthetic oligonucleotide
guugaaaauacuuuugcauuuuucc

SEQ ID NO: 5817 - RNA, 25 nt, Artificial Sequence
  Description of Artificial Sequence: Synthetic oligonucleotide
uugaaaauacuuuugcauuuuuccu

SEQ ID NO: 5818 - RNA, 25 nt, Artificial Sequence
  Description of Artificial Sequence: Synthetic oligonucleotide
ugaaaauacuuuugcauuuuuccuu

SEQ ID NO: 5819 - RNA, 25 nt, Artificial Sequence
  Description of Artificial Sequence: Synthetic oligonucleotide
uuugcauuuuuccuuugagugccaa

SEQ ID NO: 5820 - RNA, 25 nt, Artificial Sequence
  Description of Artificial Sequence: Synthetic oligonucleotide
agugccaauuucuuacuaguacuau

SEQ ID NO: 5821 - RNA, 25 nt, Artificial Sequence
  Description of Artificial Sequence: Synthetic oligonucleotide
caauuucuuacuaguacuauuucuu

SEQ ID NO: 5822 - RNA, 25 nt, Artificial Sequence
  Description of Artificial Sequence: Synthetic oligonucleotide
aauuucuuacuaguacuauuucuua

SEQ ID NO: 5823 - RNA, 25 nt, Artificial Sequence
  Description of Artificial Sequence: Synthetic oligonucleotide
cuaguacuauuucuuaauguaacau

SEQ ID NO: 5824 - RNA, 25 nt, Artificial Sequence
  Description of Artificial Sequence: Synthetic oligonucleotide
uaguacuauuucuuaauguaacaug

SEQ ID NO: 5825 - RNA, 25 nt, Artificial Sequence
  Description of Artificial Sequence: Synthetic oligonucleotide
cuauuucuuaauguaacauguuuac

SEQ ID NO: 5826 - RNA, 25 nt, Artificial Sequence
  Description of Artificial Sequence: Synthetic oligonucleotide
uauuucuuaauguaacauguuuacc

SEQ ID NO: 5827 - RNA, 25 nt, Artificial Sequence
  Description of Artificial Sequence: Synthetic oligonucleotide
auuucuuaauguaacauguuuaccu

SEQ ID NO: 5828 - RNA, 25 nt, Artificial Sequence
  Description of Artificial Sequence: Synthetic oligonucleotide
aauguaacauguuuaccuggaaugu

SEQ ID NO: 5829 - RNA, 25 nt, Artificial Sequence
  Description of Artificial Sequence: Synthetic oligonucleotide
uggaauguauuuuaacuauuuuugu

SEQ ID NO: 5830 - RNA, 25 nt, Artificial Sequence
  Description of Artificial Sequence: Synthetic oligonucleotide
gaauguauuuuaacuauuuuuguau

SEQ ID NO: 5831 - RNA, 25 nt, Artificial Sequence
  Description of Artificial Sequence: Synthetic oligonucleotide
aauguauuuuaacuauuuuuguaua

SEQ ID NO: 5832 - RNA, 25 nt, Artificial Sequence
  Description of Artificial Sequence: Synthetic oligonucleotide
auguauuuuaacuauuuuuguauag

SEQ ID NO: 5833 - RNA, 25 nt, Artificial Sequence
  Description of Artificial Sequence: Synthetic oligonucleotide
uguauuuuaacuauuuuuguauagu

SEQ ID NO: 5834 - RNA, 25 nt, Artificial Sequence
  Description of Artificial Sequence: Synthetic oligonucleotide
uauuuuaacuauuuuuguauagugu

SEQ ID NO: 5835 - RNA, 25 nt, Artificial Sequence
  Description of Artificial Sequence: Synthetic oligonucleotide
uuuuaacuauuuuuguauaguguaa

SEQ ID NO: 5836 - RNA, 25 nt, Artificial Sequence
  Description of Artificial Sequence: Synthetic oligonucleotide
uuuaacuauuuuuguauaguguaaa

SEQ ID NO: 5837 - RNA, 25 nt, Artificial Sequence
  Description of Artificial Sequence: Synthetic oligonucleotide
uuaacuauuuuuguauaguguaaac

SEQ ID NO: 5838 - RNA, 25 nt, Artificial Sequence
  Description of Artificial Sequence: Synthetic oligonucleotide
uuuuuguauaguguaaacugaaaca

SEQ ID NO: 5839 - RNA, 25 nt, Artificial Sequence
  Description of Artificial Sequence: Synthetic oligonucleotide
uuuuguauaguguaaacugaaacau

SEQ ID NO: 5840 - RNA, 25 nt, Artificial Sequence
  Description of Artificial Sequence: Synthetic oligonucleotide
uuuguauaguguaaacugaaacaug

SEQ ID NO: 5841 - RNA, 25 nt, Artificial Sequence
  Description of Artificial Sequence: Synthetic oligonucleotide
cugaaacaugcacauuuuguacauu

SEQ ID NO: 5842 - RNA, 25 nt, Artificial Sequence
  Description of Artificial Sequence: Synthetic oligonucleotide
caugcacauuuuguacauugugcuu

SEQ ID NO: 5843 - RNA, 25 nt, Artificial Sequence
  Description of Artificial Sequence: Synthetic oligonucleotide
caguuguuuuccaucauuugguugc

SEQ ID NO: 5844 - RNA, 25 nt, Artificial Sequence
  Description of Artificial Sequence: Synthetic oligonucleotide
guuguuuuccaucauuugguugcgc

SEQ ID NO: 5845 - RNA, 25 nt, Artificial Sequence
  Description of Artificial Sequence: Synthetic oligonucleotide
guuggucauaucaaacauuaaaaau

SEQ ID NO: 5846 - RNA, 25 nt, Artificial Sequence
  Description of Artificial Sequence: Synthetic oligonucleotide
uuggucauaucaaacauuaaaaaug

SEQ ID NO: 5847 - RNA, 25 nt, Artificial Sequence
  Description of Artificial Sequence: Synthetic oligonucleotide
uggucauaucaaacauuaaaaauga

SEQ ID NO: 5848 - RNA, 25 nt, Artificial Sequence
  Description of Artificial Sequence: Synthetic oligonucleotide
cauaucaaacauuaaaaaugaccac

SEQ ID NO: 5849 - RNA, 25 nt, Artificial Sequence
  Description of Artificial Sequence: Synthetic oligonucleotide
aaugaccacucuuuuaauugaaauu

SEQ ID NO: 5850 - RNA, 25 nt, Artificial Sequence
  Description of Artificial Sequence: Synthetic oligonucleotide
augaccacucuuuuaauugaaauua

SEQ ID NO: 5851 - RNA, 25 nt, Artificial Sequence
  Description of Artificial Sequence: Synthetic oligonucleotide
cuuuuaauugaaauuaacuuuuaaa

SEQ ID NO: 5852 - RNA, 25 nt, Artificial Sequence
  Description of Artificial Sequence: Synthetic oligonucleotide
uuuuaauugaaauuaacuuuuaaau

SEQ ID NO: 5853 - RNA, 25 nt, Artificial Sequence
  Description of Artificial Sequence: Synthetic oligonucleotide
uuaauugaaauuaacuuuuaaaugu

SEQ ID NO: 5854 - RNA, 25 nt, Artificial Sequence
  Description of Artificial Sequence: Synthetic oligonucleotide
aauugaaauuaacuuuuaaauguuu

SEQ ID NO: 5855 - RNA, 25 nt, Artificial Sequence
  Description of Artificial Sequence: Synthetic oligonucleotide
auugaaauuaacuuuuaaauguuua

SEQ ID NO: 5856 - RNA, 25 nt, Artificial Sequence
  Description of Artificial Sequence: Synthetic oligonucleotide
uugaaauuaacuuuuaaauguuuau

SEQ ID NO: 5857 - RNA, 25 nt, Artificial Sequence
  Description of Artificial Sequence: Synthetic oligonucleotide
ugaaauuaacuuuuaaauguuuaua

SEQ ID NO: 5858 - RNA, 25 nt, Artificial Sequence
  Description of Artificial Sequence: Synthetic oligonucleotide
gaaauuaacuuuuaaauguuuauag

SEQ ID NO: 5859 - RNA, 25 nt, Artificial Sequence
  Description of Artificial Sequence: Synthetic oligonucleotide
aaauuaacuuuuaaauguuuauagg

SEQ ID NO: 5860 - RNA, 25 nt, Artificial Sequence
  Description of Artificial Sequence: Synthetic oligonucleotide
uuaacuuuuaaauguuuauaggagu

SEQ ID NO: 5861 - RNA, 25 nt, Artificial Sequence
  Description of Artificial Sequence: Synthetic oligonucleotide
cuuuuaaauguuuauaggaguaugu

SEQ ID NO: 5862 - RNA, 25 nt, Artificial Sequence
  Description of Artificial Sequence: Synthetic oligonucleotide
uaaauguuuauaggaguaugugcug

SEQ ID NO: 5863 - RNA, 25 nt, Artificial Sequence
  Description of Artificial Sequence: Synthetic oligonucleotide
aaauguuuauaggaguaugugcugu

SEQ ID NO: 5864 - RNA, 25 nt, Artificial Sequence
  Description of Artificial Sequence: Synthetic oligonucleotide
ugugaagugaucuaaaauuuguaau

SEQ ID NO: 5865 - RNA, 25 nt, Artificial Sequence
  Description of Artificial Sequence: Synthetic oligonucleotide
ugaagugaucuaaaauuuguaauau

SEQ ID NO: 5866 - RNA, 25 nt, Artificial Sequence
  Description of Artificial Sequence: Synthetic oligonucleotide
gaagugaucuaaaauuuguaauauu

SEQ ID NO: 5867 - RNA, 25 nt, Artificial Sequence
  Description of Artificial Sequence: Synthetic oligonucleotide
aagugaucuaaaauuuguaauauuu

SEQ ID NO: 5868 - RNA, 25 nt, Artificial Sequence
  Description of Artificial Sequence: Synthetic oligonucleotide
agugaucuaaaauuuguaauauuuu

SEQ ID NO: 5869 - RNA, 25 nt, Artificial Sequence
  Description of Artificial Sequence: Synthetic oligonucleotide
gugaucuaaaauuuguaauauuuuu

SEQ ID NO: 5870 - RNA, 25 nt, Artificial Sequence
  Description of Artificial Sequence: Synthetic oligonucleotide
ugaucuaaaauuuguaauauuuuug

SEQ ID NO: 5871 - RNA, 25 nt, Artificial Sequence
  Description of Artificial Sequence: Synthetic oligonucleotide
cuaaaauuuguaauauuuuugucau

SEQ ID NO: 5872 - RNA, 25 nt, Artificial Sequence
  Description of Artificial Sequence: Synthetic oligonucleotide
uaaaauuuguaauauuuuugucaug

SEQ ID NO: 5873 - RNA, 25 nt, Artificial Sequence
  Description of Artificial Sequence: Synthetic oligonucleotide
auuuguaauauuuuugucaugaacu

SEQ ID NO: 5874 - RNA, 25 nt, Artificial Sequence
  Description of Artificial Sequence: Synthetic oligonucleotide
uuuguaauauuuuugucaugaacug

SEQ ID NO: 5875 - RNA, 25 nt, Artificial Sequence
  Description of Artificial Sequence: Synthetic oligonucleotide
uuguaauauuuuugucaugaacugu

SEQ ID NO: 5876 - RNA, 25 nt, Artificial Sequence
  Description of Artificial Sequence: Synthetic oligonucleotide
aauauuuuugucaugaacuguacua

SEQ ID NO: 5877 - RNA, 25 nt, Artificial Sequence
  Description of Artificial Sequence: Synthetic oligonucleotide
auauuuuugucaugaacuguacuac

SEQ ID NO: 5878 - RNA, 25 nt, Artificial Sequence
  Description of Artificial Sequence: Synthetic oligonucleotide
cuguacuacuccuaauuauuguaau

SEQ ID NO: 5879 - RNA, 25 nt, Artificial Sequence
  Description of Artificial Sequence: Synthetic oligonucleotide
uguacuacuccuaauuauuguaaug

SEQ ID NO: 5880 - RNA, 25 nt, Artificial Sequence
  Description of Artificial Sequence: Synthetic oligonucleotide
cuaauuauuguaauguaauaaaaau

SEQ ID NO: 5881 - RNA, 25 nt, Artificial Sequence
  Description of Artificial Sequence: Synthetic oligonucleotide
uaauuauuguaauguaauaaaaaua

SEQ ID NO: 5882 - RNA, 25 nt, Artificial Sequence
  Description of Artificial Sequence: Synthetic oligonucleotide
auuauuguaauguaauaaaaauagu

SEQ ID NO: 5883 - RNA, 25 nt, Artificial Sequence
  Description of Artificial Sequence: Synthetic oligonucleotide
uauuguaauguaauaaaaauaguua

SEQ ID NO: 5884 - RNA, 25 nt, Artificial Sequence
  Description of Artificial Sequence: Synthetic oligonucleotide
auuguaauguaauaaaaauaguuac

SEQ ID NO: 5885 - RNA, 25 nt, Artificial Sequence
  Description of Artificial Sequence: Synthetic oligonucleotide
uguaauguaauaaaaauaguuacag

SEQ ID NO: 5886 - RNA, 25 nt, Artificial Sequence
  Description of Artificial Sequence: Synthetic oligonucleotide
guaauguaauaaaaauaguuacagu

SEQ ID NO: 5887 - RNA, 25 nt, Artificial Sequence
  Description of Artificial Sequence: Synthetic oligonucleotide
uguaauaaaaauaguuacagugaca

SEQ ID NO: 5888 - RNA, 25 nt, Artificial Sequence
  Description of Artificial Sequence: Synthetic oligonucleotide
guaauaaaaauaguuacagugacaa

SEQ ID NO: 5889 - RNA, 25 nt, Artificial Sequence
  Description of Artificial Sequence: Synthetic oligonucleotide
uaauaaaaauaguuacagugacaaa

SEQ ID NO: 5890 - RNA, 25 nt, Artificial Sequence
  Description of Artificial Sequence: Synthetic oligonucleotide
auaguuacagugacaaaaaaaaaaa

SEQ ID NO: 5891 - RNA, 25 nt, Artificial Sequence
  Description of Artificial Sequence: Synthetic oligonucleotide
uaguuacagugacaaaaaaaaaaaa

SEQ ID NO: 5892 - RNA, 25 nt, Artificial Sequence
  Description of Artificial Sequence: Synthetic oligonucleotide
guuacagugacaaaaaaaaaaaaaa

SEQ ID NO: 5893 - RNA, 25 nt, Artificial Sequence
  Description of Artificial Sequence: Synthetic oligonucleotide
ugcugaaaaugacugaauauaaacu

SEQ ID NO: 5894 - RNA, 25 nt, Artificial Sequence
  Description of Artificial Sequence: Synthetic oligonucleotide
aaaugacugaauauaaacuuguggu

SEQ ID NO: 5895 - RNA, 25 nt, Artificial Sequence
  Description of Artificial Sequence: Synthetic oligonucleotide
gacugaauauaaacuugugguaguu

SEQ ID NO: 5896 - RNA, 25 nt, Artificial Sequence
  Description of Artificial Sequence: Synthetic oligonucleotide
agcuaauucagaaucauuuugugga

SEQ ID NO: 5897 - RNA, 25 nt, Artificial Sequence
  Description of Artificial Sequence: Synthetic oligonucleotide
acgaauaugauccaacaauagagga

SEQ ID NO: 5898 - RNA, 25 nt, Artificial Sequence
  Description of Artificial Sequence: Synthetic oligonucleotide
agcaaguaguaauugauggagaaac

SEQ ID NO: 5899 - RNA, 25 nt, Artificial Sequence
  Description of Artificial Sequence: Synthetic oligonucleotide
ggagggcuuucuuuguguauuugcc

SEQ ID NO: 5900 - RNA, 25 nt, Artificial Sequence
  Description of Artificial Sequence: Synthetic oligonucleotide
ucuuuguguauuugccauaaauaau

SEQ ID NO: 5901 - RNA, 25 nt, Artificial Sequence
  Description of Artificial Sequence: Synthetic oligonucleotide
cuuuguguauuugccauaaauaaua

SEQ ID NO: 5902 - RNA, 25 nt, Artificial Sequence
  Description of Artificial Sequence: Synthetic oligonucleotide
uuuguguauuugccauaaauaauac

SEQ ID NO: 5903 - RNA, 25 nt, Artificial Sequence
  Description of Artificial Sequence: Synthetic oligonucleotide
uuguguauuugccauaaauaauacu

SEQ ID NO: 5904 - RNA, 25 nt, Artificial Sequence
  Description of Artificial Sequence: Synthetic oligonucleotide
guauuugccauaaauaauacuaaau

SEQ ID NO: 5905 - RNA, 25 nt, Artificial Sequence
  Description of Artificial Sequence: Synthetic oligonucleotide
uauuugccauaaauaauacuaaauc

SEQ ID NO: 5906 - RNA, 25 nt, Artificial Sequence
  Description of Artificial Sequence: Synthetic oligonucleotide
ccauaaauaauacuaaaucauuuga

SEQ ID NO: 5907 - RNA, 25 nt, Artificial Sequence
  Description of Artificial Sequence: Synthetic oligonucleotide
cauaaauaauacuaaaucauuugaa

SEQ ID NO: 5908 - RNA, 25 nt, Artificial Sequence
  Description of Artificial Sequence: Synthetic oligonucleotide
uaaauaauacuaaaucauuugaaga

SEQ ID NO: 5909 - RNA, 25 nt, Artificial Sequence
  Description of Artificial Sequence: Synthetic oligonucleotide
aaauaauacuaaaucauuugaagau

SEQ ID NO: 5910 - RNA, 25 nt, Artificial Sequence
  Description of Artificial Sequence: Synthetic oligonucleotide
aauaauacuaaaucauuugaagaua

SEQ ID NO: 5911 - RNA, 25 nt, Artificial Sequence
  Description of Artificial Sequence: Synthetic oligonucleotide
auaauacuaaaucauuugaagauau

SEQ ID NO: 5912 - RNA, 25 nt, Artificial Sequence
  Description of Artificial Sequence: Synthetic oligonucleotide
auuugaagauauucaccauuauaga

SEQ ID NO: 5913 - RNA, 25 nt, Artificial Sequence
  Description of Artificial Sequence: Synthetic oligonucleotide
uugaagauauucaccauuauagaga

SEQ ID NO: 5914 - RNA, 25 nt, Artificial Sequence
  Description of Artificial Sequence: Synthetic oligonucleotide
ugaagauauucaccauuauagagaa

SEQ ID NO: 5915 - RNA, 25 nt, Artificial Sequence
  Description of Artificial Sequence: Synthetic oligonucleotide
gaagauauucaccauuauagagaac

SEQ ID NO: 5916 - RNA, 25 nt, Artificial Sequence
  Description of Artificial Sequence: Synthetic oligonucleotide
aagauauucaccauuauagagaaca

SEQ ID NO: 5917 - RNA, 25 nt, Artificial Sequence
  Description of Artificial Sequence: Synthetic oligonucleotide
ccauuauagagaacaaauuaaaaga

SEQ ID NO: 5918 - RNA, 25 nt, Artificial Sequence
  Description of Artificial Sequence: Synthetic oligonucleotide
auuauagagaacaaauuaaaagagu

SEQ ID NO: 5919 - RNA, 25 nt, Artificial Sequence
  Description of Artificial Sequence: Synthetic oligonucleotide
uuauagagaacaaauuaaaagaguu

SEQ ID NO: 5920 - RNA, 25 nt, Artificial Sequence
  Description of Artificial Sequence: Synthetic oligonucleotide
uauagagaacaaauuaaaagaguua

SEQ ID NO: 5921 - RNA, 25 nt, Artificial Sequence
  Description of Artificial Sequence: Synthetic oligonucleotide
auagagaacaaauuaaaagaguuaa

SEQ ID NO: 5922 - RNA, 25 nt, Artificial Sequence
  Description of Artificial Sequence: Synthetic oligonucleotide
cuaguaggaaauaaaugugauuugc

SEQ ID NO: 5923 - RNA, 25 nt, Artificial Sequence
  Description of Artificial Sequence: Synthetic oligonucleotide
uaguaggaaauaaaugugauuugcc

SEQ ID NO: 5924 - RNA, 25 nt, Artificial Sequence
  Description of Artificial Sequence: Synthetic oligonucleotide
aagaaguuauggaauuccuuuuauu

SEQ ID NO: 5925 - RNA, 25 nt, Artificial Sequence
  Description of Artificial Sequence: Synthetic oligonucleotide
aaguuauggaauuccuuuuauugaa

SEQ ID NO: 5926 - RNA, 25 nt, Artificial Sequence
  Description of Artificial Sequence: Synthetic oligonucleotide
aguuauggaauuccuuuuauugaaa

SEQ ID NO: 5927 - RNA, 25 nt, Artificial Sequence
  Description of Artificial Sequence: Synthetic oligonucleotide
guuauggaauuccuuuuauugaaac

SEQ ID NO: 5928 - RNA, 25 nt, Artificial Sequence
  Description of Artificial Sequence: Synthetic oligonucleotide
uuauggaauuccuuuuauugaaaca

SEQ ID NO: 5929 - RNA, 25 nt, Artificial Sequence
  Description of Artificial Sequence: Synthetic oligonucleotide
uggaggaugcuuuuuauacauuggu

SEQ ID NO: 5930 - RNA, 25 nt, Artificial Sequence
  Description of Artificial Sequence: Synthetic oligonucleotide
gaggaugcuuuuuauacauugguga

SEQ ID NO: 5931 - RNA, 25 nt, Artificial Sequence
  Description of Artificial Sequence: Synthetic oligonucleotide
acagauugaaaaaaaucagcaaaga

SEQ ID NO: 5932 - RNA, 25 nt, Artificial Sequence
  Description of Artificial Sequence: Synthetic oligonucleotide
cagauugaaaaaaaucagcaaagaa

SEQ ID NO: 5933 - RNA, 25 nt, Artificial Sequence
  Description of Artificial Sequence: Synthetic oligonucleotide
gauugaaaaaaaucagcaaagaaga

SEQ ID NO: 5934 - RNA, 25 nt, Artificial Sequence
  Description of Artificial Sequence: Synthetic oligonucleotide
auugaaaaaaaucagcaaagaagaa

SEQ ID NO: 5935 - RNA, 25 nt, Artificial Sequence
  Description of Artificial Sequence: Synthetic oligonucleotide
uugaaaaaaaucagcaaagaagaaa

SEQ ID NO: 5936 - RNA, 25 nt, Artificial Sequence
  Description of Artificial Sequence: Synthetic oligonucleotide
ugaaaaaaaucagcaaagaagaaaa

SEQ ID NO: 5937 - RNA, 25 nt, Artificial Sequence
  Description of Artificial Sequence: Synthetic oligonucleotide
uccuggcugugugaaaauuaaaaaa

SEQ ID NO: 5938 - RNA, 25 nt, Artificial Sequence
  Description of Artificial Sequence: Synthetic oligonucleotide
ggcugugugaaaauuaaaaaaugca

SEQ ID NO: 5939 - RNA, 25 nt, Artificial Sequence
  Description of Artificial Sequence: Synthetic oligonucleotide
gugugaaaauuaaaaaaugcauuau

SEQ ID NO: 5940 - RNA, 25 nt, Artificial Sequence
  Description of Artificial Sequence: Synthetic oligonucleotide
ugugaaaauuaaaaaaugcauuaua

SEQ ID NO: 5941 - RNA, 25 nt, Artificial Sequence
  Description of Artificial Sequence: Synthetic oligonucleotide
gugaaaauuaaaaaaugcauuauaa

SEQ ID NO: 5942 - RNA, 25 nt, Artificial Sequence
  Description of Artificial Sequence: Synthetic oligonucleotide
ugaaaauuaaaaaaugcauuauaau

SEQ ID NO: 5943 - RNA, 25 nt, Artificial Sequence
  Description of Artificial Sequence: Synthetic oligonucleotide
aaaauuaaaaaaugcauuauaaugu

SEQ ID NO: 5944 - RNA, 25 nt, Artificial Sequence
  Description of Artificial Sequence: Synthetic oligonucleotide
aaauuaaaaaaugcauuauaaugua

SEQ ID NO: 5945 - RNA, 25 nt, Artificial Sequence
  Description of Artificial Sequence: Synthetic oligonucleotide
aauuaaaaaaugcauuauaauguaa

SEQ ID NO: 5946 - RNA, 25 nt, Artificial Sequence
  Description of Artificial Sequence: Synthetic oligonucleotide
auuaaaaaaugcauuauaauguaau

SEQ ID NO: 5947 - RNA, 25 nt, Artificial Sequence
  Description of Artificial Sequence: Synthetic oligonucleotide
uaaaaaaugcauuauaauguaaucu

SEQ ID NO: 5948 - RNA, 25 nt, Artificial Sequence
  Description of Artificial Sequence: Synthetic oligonucleotide
ugcauuauaauguaaucuggguguu

SEQ ID NO: 5949 - RNA, 25 nt, Artificial Sequence
  Description of Artificial Sequence: Synthetic oligonucleotide
uucgagaaauucgaaaacauaaaga

SEQ ID NO: 5950 - RNA, 25 nt, Artificial Sequence
  Description of Artificial Sequence: Synthetic oligonucleotide
ucgagaaauucgaaaacauaaagaa

SEQ ID NO: 5951 - RNA, 25 nt, Artificial Sequence
  Description of Artificial Sequence: Synthetic oligonucleotide
cgagaaauucgaaaacauaaagaaa

SEQ ID NO: 5952 - RNA, 25 nt, Artificial Sequence
  Description of Artificial Sequence: Synthetic oligonucleotide
gaaauucgaaaacauaaagaaaaga

SEQ ID NO: 5953 - RNA, 25 nt, Artificial Sequence
  Description of Artificial Sequence: Synthetic oligonucleotide
ucgaaaacauaaagaaaagaugagc

SEQ ID NO: 5954 - RNA, 25 nt, Artificial Sequence
  Description of Artificial Sequence: Synthetic oligonucleotide
cgaaaacauaaagaaaagaugagca

SEQ ID NO: 5955 - RNA, 25 nt, Artificial Sequence
  Description of Artificial Sequence: Synthetic oligonucleotide
aaagaugguaaaaagaagaaaaaga

SEQ ID NO: 5956 - RNA, 25 nt, Artificial Sequence
  Description of Artificial Sequence: Synthetic oligonucleotide
aagaugguaaaaagaagaaaaagaa

SEQ ID NO: 5957 - RNA, 25 nt, Artificial Sequence
  Description of Artificial Sequence: Synthetic oligonucleotide
gaugguaaaaagaagaaaaagaagu

SEQ ID NO: 5958 - RNA, 25 nt, Artificial Sequence
  Description of Artificial Sequence: Synthetic oligonucleotide
augguaaaaagaagaaaaagaaguc

SEQ ID NO: 5959 - RNA, 25 nt, Artificial Sequence
  Description of Artificial Sequence: Synthetic oligonucleotide
aaaaagaagaaaaagaagucaaaga

SEQ ID NO: 5960 - RNA, 25 nt, Artificial Sequence
  Description of Artificial Sequence: Synthetic oligonucleotide
aaaagaagaaaaagaagucaaagac

SEQ ID NO: 5961 - RNA, 25 nt, Artificial Sequence
  Description of Artificial Sequence: Synthetic oligonucleotide
aaagaagaaaaagaagucaaagaca

SEQ ID NO: 5962 - RNA, 25 nt, Artificial Sequence
  Description of Artificial Sequence: Synthetic oligonucleotide
ucaaagacaaaguguguaauuaugu

SEQ ID NO: 5963 - RNA, 25 nt, Artificial Sequence
  Description of Artificial Sequence: Synthetic oligonucleotide
caaagacaaaguguguaauuaugua

SEQ ID NO: 5964 - RNA, 25 nt, Artificial Sequence
  Description of Artificial Sequence: Synthetic oligonucleotide
gacaaaguguguaauuauguaaaua

SEQ ID NO: 5965 - RNA, 25 nt, Artificial Sequence
  Description of Artificial Sequence: Synthetic oligonucleotide
caaaguguguaauuauguaaauaca

SEQ ID NO: 5966 - RNA, 25 nt, Artificial Sequence
  Description of Artificial Sequence: Synthetic oligonucleotide
guguguaauuauguaaauacaauuu

SEQ ID NO: 5967 - RNA, 25 nt, Artificial Sequence
  Description of Artificial Sequence: Synthetic oligonucleotide
guguaauuauguaaauacaauuugu

SEQ ID NO: 5968 - RNA, 25 nt, Artificial Sequence
  Description of Artificial Sequence: Synthetic oligonucleotide
guaauuauguaaauacaauuuguac

SEQ ID NO: 5969 - RNA, 25 nt, Artificial Sequence
  Description of Artificial Sequence: Synthetic oligonucleotide
uaauuauguaaauacaauuuguacu

SEQ ID NO: 5970 - RNA, 25 nt, Artificial Sequence
  Description of Artificial Sequence: Synthetic oligonucleotide
uauguaaauacaauuuguacuuuuu

SEQ ID NO: 5971 - RNA, 25 nt, Artificial Sequence
  Description of Artificial Sequence: Synthetic oligonucleotide
auguaaauacaauuuguacuuuuuu

SEQ ID NO: 5972 - RNA, 25 nt, Artificial Sequence
  Description of Artificial Sequence: Synthetic oligonucleotide
uguaaauacaauuuguacuuuuuuc

SEQ ID NO: 5973 - RNA, 25 nt, Artificial Sequence
  Description of Artificial Sequence: Synthetic oligonucleotide
guaaauacaauuuguacuuuuuucu

SEQ ID NO: 5974 - RNA, 25 nt, Artificial Sequence
  Description of Artificial Sequence: Synthetic oligonucleotide
acaauuuguacuuuuuucuuaaggc

SEQ ID NO: 5975 - RNA, 25 nt, Artificial Sequence
  Description of Artificial Sequence: Synthetic oligonucleotide
caauuuguacuuuuuucuuaaggca

SEQ ID NO: 5976 - RNA, 25 nt, Artificial Sequence
  Description of Artificial Sequence: Synthetic oligonucleotide
uacuaguacaagugguaauuuuugu

SEQ ID NO: 5977 - RNA, 25 nt, Artificial Sequence
  Description of Artificial Sequence: Synthetic oligonucleotide
acuaguacaagugguaauuuuugua

SEQ ID NO: 5978 - RNA, 25 nt, Artificial Sequence
  Description of Artificial Sequence: Synthetic oligonucleotide
acaagugguaauuuuuguacauuac

SEQ ID NO: 5979 - RNA, 25 nt, Artificial Sequence
  Description of Artificial Sequence: Synthetic oligonucleotide
caagugguaauuuuuguacauuaca

SEQ ID NO: 5980 - RNA, 25 nt, Artificial Sequence
  Description of Artificial Sequence: Synthetic oligonucleotide
uaauuuuuguacauuacacuaaauu

SEQ ID NO: 5981 - RNA, 25 nt, Artificial Sequence
  Description of Artificial Sequence: Synthetic oligonucleotide
aauuuuuguacauuacacuaaauua

SEQ ID NO: 5982 - RNA, 25 nt, Artificial Sequence
  Description of Artificial Sequence: Synthetic oligonucleotide
auuuuuguacauuacacuaaauuau

SEQ ID NO: 5983 - RNA, 25 nt, Artificial Sequence
  Description of Artificial Sequence: Synthetic oligonucleotide
uuuuuguacauuacacuaaauuauu

SEQ ID NO: 5984 - RNA, 25 nt, Artificial Sequence
  Description of Artificial Sequence: Synthetic oligonucleotide
uuuuguacauuacacuaaauuauua

SEQ ID NO: 5985 - RNA, 25 nt, Artificial Sequence
  Description of Artificial Sequence: Synthetic oligonucleotide
cacuaaauuauuagcauuuguuuua

SEQ ID NO: 5986 - RNA, 25 nt, Artificial Sequence
  Description of Artificial Sequence: Synthetic oligonucleotide
cuaaauuauuagcauuuguuuuagc

SEQ ID NO: 5987 - RNA, 25 nt, Artificial Sequence
  Description of Artificial Sequence: Synthetic oligonucleotide
uaaauuauuagcauuuguuuuagca

SEQ ID NO: 5988 - RNA, 25 nt, Artificial Sequence
  Description of Artificial Sequence: Synthetic oligonucleotide
uauuagcauuuguuuuagcauuacc

SEQ ID NO: 5989 - RNA, 25 nt, Artificial Sequence
  Description of Artificial Sequence: Synthetic oligonucleotide
cauuuguuuuagcauuaccuaauuu

SEQ ID NO: 5990 - RNA, 25 nt, Artificial Sequence
  Description of Artificial Sequence: Synthetic oligonucleotide
auuuguuuuagcauuaccuaauuuu

SEQ ID NO: 5991 - RNA, 25 nt, Artificial Sequence
  Description of Artificial Sequence: Synthetic oligonucleotide
uuguuuuagcauuaccuaauuuuuu

SEQ ID NO: 5992 - RNA, 25 nt, Artificial Sequence
  Description of Artificial Sequence: Synthetic oligonucleotide
uguuuuagcauuaccuaauuuuuuu

SEQ ID NO: 5993 - RNA, 25 nt, Artificial Sequence
  Description of Artificial Sequence: Synthetic oligonucleotide
guuuuagcauuaccuaauuuuuuuc

SEQ ID NO: 5994 - RNA, 25 nt, Artificial Sequence
  Description of Artificial Sequence: Synthetic oligonucleotide
uuuuagcauuaccuaauuuuuuucc

SEQ ID NO: 5995 - RNA, 25 nt, Artificial Sequence
  Description of Artificial Sequence: Synthetic oligonucleotide
gacuguuagcuuuuaccuuaaaugc

SEQ ID NO: 5996 - RNA, 25 nt, Artificial Sequence
  Description of Artificial Sequence: Synthetic oligonucleotide
acuguuagcuuuuaccuuaaaugcu

SEQ ID NO: 5997 - RNA, 25 nt, Artificial Sequence
  Description of Artificial Sequence: Synthetic oligonucleotide
agcuuuuaccuuaaaugcuuauuuu

SEQ ID NO: 5998 - RNA, 25 nt, Artificial Sequence
  Description of Artificial Sequence: Synthetic oligonucleotide
gcuuuuaccuuaaaugcuuauuuua

SEQ ID NO: 5999 - RNA, 25 nt, Artificial Sequence
  Description of Artificial Sequence: Synthetic oligonucleotide
cuuuuaccuuaaaugcuuauuuuaa

SEQ ID NO: 6000 - RNA, 25 nt, Artificial Sequence
  Description of Artificial Sequence: Synthetic oligonucleotide
ccuuaaaugcuuauuuuaaaaugac

SEQ ID NO: 6001 - RNA, 25 nt, Artificial Sequence
  Description of Artificial Sequence: Synthetic oligonucleotide
cuuaaaugcuuauuuuaaaaugaca

SEQ ID NO: 6002 - RNA, 25 nt, Artificial Sequence
  Description of Artificial Sequence: Synthetic oligonucleotide
ugcuuauuuuaaaaugacaguggaa

SEQ ID NO: 6003 - RNA, 25 nt, Artificial Sequence
  Description of Artificial Sequence: Synthetic oligonucleotide
cuuauuuuaaaaugacaguggaagu

SEQ ID NO: 6004 - RNA, 25 nt, Artificial Sequence
  Description of Artificial Sequence: Synthetic oligonucleotide
guggaaguuuuuuuuuccucuaagu

SEQ ID NO: 6005 - RNA, 25 nt, Artificial Sequence
  Description of Artificial Sequence: Synthetic oligonucleotide
ggaaguuuuuuuuuccucuaagugc

SEQ ID NO: 6006 - RNA, 25 nt, Artificial Sequence
  Description of Artificial Sequence: Synthetic oligonucleotide
gaaguuuuuuuuuccucuaagugcc

SEQ ID NO: 6007 - RNA, 25 nt, Artificial Sequence
  Description of Artificial Sequence: Synthetic oligonucleotide
uuuugguuuuugaacuagcaaugcc

SEQ ID NO: 6008 - RNA, 25 nt, Artificial Sequence
  Description of Artificial Sequence: Synthetic oligonucleotide
gccugugaaaaagaaacugaauacc

SEQ ID NO: 6009 - RNA, 25 nt, Artificial Sequence
  Description of Artificial Sequence: Synthetic oligonucleotide
aaaaagaaacugaauaccuaagauu

SEQ ID NO: 6010 - RNA, 25 nt, Artificial Sequence
  Description of Artificial Sequence: Synthetic oligonucleotide
aaaagaaacugaauaccuaagauuu

SEQ ID NO: 6011 - RNA, 25 nt, Artificial Sequence
  Description of Artificial Sequence: Synthetic oligonucleotide
aacugaauaccuaagauuucugucu

SEQ ID NO: 6012 - RNA, 25 nt, Artificial Sequence
  Description of Artificial Sequence: Synthetic oligonucleotide
ugcaguugauuacuucuuauuuuuc

SEQ ID NO: 6013 - RNA, 25 nt, Artificial Sequence
  Description of Artificial Sequence: Synthetic oligonucleotide
gcaguugauuacuucuuauuuuucu

SEQ ID NO: 6014 - RNA, 25 nt, Artificial Sequence
  Description of Artificial Sequence: Synthetic oligonucleotide
uugauuacuucuuauuuuucuuacc

SEQ ID NO: 6015 - RNA, 25 nt, Artificial Sequence
  Description of Artificial Sequence: Synthetic oligonucleotide
uucuuauuuuucuuaccaauuguga

SEQ ID NO: 6016 - RNA, 25 nt, Artificial Sequence
  Description of Artificial Sequence: Synthetic oligonucleotide
ucuuauuuuucuuaccaauugugaa

SEQ ID NO: 6017 - RNA, 25 nt, Artificial Sequence
  Description of Artificial Sequence: Synthetic oligonucleotide
cuuauuuuucuuaccaauugugaau

SEQ ID NO: 6018 - RNA, 25 nt, Artificial Sequence
  Description of Artificial Sequence: Synthetic oligonucleotide
auguuggugugaaacaaauuaauga

SEQ ID NO: 6019 - RNA, 25 nt, Artificial Sequence
  Description of Artificial Sequence: Synthetic oligonucleotide
uuggugugaaacaaauuaaugaagc

SEQ ID NO: 6020 - RNA, 25 nt, Artificial Sequence
  Description of Artificial Sequence: Synthetic oligonucleotide
uggugugaaacaaauuaaugaagcu

SEQ ID NO: 6021 - RNA, 25 nt, Artificial Sequence
  Description of Artificial Sequence: Synthetic oligonucleotide
aacaaauuaaugaagcuuuugaauc

SEQ ID NO: 6022 - RNA, 25 nt, Artificial Sequence
  Description of Artificial Sequence: Synthetic oligonucleotide
acaaauuaaugaagcuuuugaauca

SEQ ID NO: 6023 - RNA, 25 nt, Artificial Sequence
  Description of Artificial Sequence: Synthetic oligonucleotide
ucuguguuuuaucuagucacauaaa

SEQ ID NO: 6024 - RNA, 25 nt, Artificial Sequence
  Description of Artificial Sequence: Synthetic oligonucleotide
cuguguuuuaucuagucacauaaau

SEQ ID NO: 6025 - RNA, 25 nt, Artificial Sequence
  Description of Artificial Sequence: Synthetic oligonucleotide
uguuuuaucuagucacauaaaugga

SEQ ID NO: 6026 - RNA, 25 nt, Artificial Sequence
  Description of Artificial Sequence: Synthetic oligonucleotide
guuuuaucuagucacauaaauggau

SEQ ID NO: 6027 - RNA, 25 nt, Artificial Sequence
  Description of Artificial Sequence: Synthetic oligonucleotide
aucuagucacauaaauggauuaauu

SEQ ID NO: 6028 - RNA, 25 nt, Artificial Sequence
  Description of Artificial Sequence: Synthetic oligonucleotide
ucuagucacauaaauggauuaauua

SEQ ID NO: 6029 - RNA, 25 nt, Artificial Sequence
  Description of Artificial Sequence: Synthetic oligonucleotide
cauaaauggauuaauuacuaauuuc

SEQ ID NO: 6030 - RNA, 25 nt, Artificial Sequence
  Description of Artificial Sequence: Synthetic oligonucleotide
auaaauggauuaauuacuaauuuca

SEQ ID NO: 6031 - RNA, 25 nt, Artificial Sequence
  Description of Artificial Sequence: Synthetic oligonucleotide
uggauuaauuacuaauuucaguuga

SEQ ID NO: 6032 - RNA, 25 nt, Artificial Sequence
  Description of Artificial Sequence: Synthetic oligonucleotide
gauuaauuacuaauuucaguugaga

SEQ ID NO: 6033 - RNA, 25 nt, Artificial Sequence
  Description of Artificial Sequence: Synthetic oligonucleotide
auuaauuacuaauuucaguugagac

SEQ ID NO: 6034 - RNA, 25 nt, Artificial Sequence
  Description of Artificial Sequence: Synthetic oligonucleotide
uuaauuacuaauuucaguugagacc

SEQ ID NO: 6035 - RNA, 25 nt, Artificial Sequence
  Description of Artificial Sequence: Synthetic oligonucleotide
uaauugguuuuuacugaaacauuga

SEQ ID NO: 6036 - RNA, 25 nt, Artificial Sequence
  Description of Artificial Sequence: Synthetic oligonucleotide
ugguuuuuacugaaacauugaggga

SEQ ID NO: 6037 - RNA, 25 nt, Artificial Sequence
  Description of Artificial Sequence: Synthetic oligonucleotide
gguuuuuacugaaacauugagggaa

SEQ ID NO: 6038 - RNA, 25 nt, Artificial Sequence
  Description of Artificial Sequence: Synthetic oligonucleotide
auugagggaacacaaauuuaugggc

SEQ ID NO: 6039 - RNA, 25 nt, Artificial Sequence
  Description of Artificial Sequence: Synthetic oligonucleotide
uugagggaacacaaauuuaugggcu

SEQ ID NO: 6040 - RNA, 25 nt, Artificial Sequence
  Description of Artificial Sequence: Synthetic oligonucleotide
ugaugaauguaaaguuacacuguuc

SEQ ID NO: 6041 - RNA, 25 nt, Artificial Sequence
  Description of Artificial Sequence: Synthetic oligonucleotide
gaugaauguaaaguuacacuguuca

SEQ ID NO: 6042 - RNA, 25 nt, Artificial Sequence
  Description of Artificial Sequence: Synthetic oligonucleotide
ccaaaauauuauauuuuuucuauaa

SEQ ID NO: 6043 - RNA, 25 nt, Artificial Sequence
  Description of Artificial Sequence: Synthetic oligonucleotide
caaaauauuauauuuuuucuauaaa

SEQ ID NO: 6044 - RNA, 25 nt, Artificial Sequence
  Description of Artificial Sequence: Synthetic oligonucleotide
aaaauauuauauuuuuucuauaaaa

SEQ ID NO: 6045 - RNA, 25 nt, Artificial Sequence
  Description of Artificial Sequence: Synthetic oligonucleotide
aaauauuauauuuuuucuauaaaaa

SEQ ID NO: 6046 - RNA, 25 nt, Artificial Sequence
  Description of Artificial Sequence: Synthetic oligonucleotide
auauuauauuuuuucuauaaaaaga

SEQ ID NO: 6047 - RNA, 25 nt, Artificial Sequence
  Description of Artificial Sequence: Synthetic oligonucleotide
uauuauauuuuuucuauaaaaagaa

SEQ ID NO: 6048 - RNA, 25 nt, Artificial Sequence
  Description of Artificial Sequence: Synthetic oligonucleotide
auuauauuuuuucuauaaaaagaaa

SEQ ID NO: 6049 - RNA, 25 nt, Artificial Sequence
  Description of Artificial Sequence: Synthetic oligonucleotide
uuauauuuuuucuauaaaaagaaaa

SEQ ID NO: 6050 - RNA, 25 nt, Artificial Sequence
  Description of Artificial Sequence: Synthetic oligonucleotide
uauauuuuuucuauaaaaagaaaaa

SEQ ID NO: 6051 - RNA, 25 nt, Artificial Sequence
  Description of Artificial Sequence: Synthetic oligonucleotide
auauuuuuucuauaaaaagaaaaaa

SEQ ID NO: 6052 - RNA, 25 nt, Artificial Sequence
  Description of Artificial Sequence: Synthetic oligonucleotide
uauuuuuucuauaaaaagaaaaaaa

SEQ ID NO: 6053 - RNA, 25 nt, Artificial Sequence
  Description of Artificial Sequence: Synthetic oligonucleotide
auuuuuucuauaaaaagaaaaaaau

SEQ ID NO: 6054 - RNA, 25 nt, Artificial Sequence
  Description of Artificial Sequence: Synthetic oligonucleotide
uucuauaaaaagaaaaaaauggaaa

SEQ ID NO: 6055 - RNA, 25 nt, Artificial Sequence
  Description of Artificial Sequence: Synthetic oligonucleotide
ucuauaaaaagaaaaaaauggaaaa

SEQ ID NO: 6056 - RNA, 25 nt, Artificial Sequence
  Description of Artificial Sequence: Synthetic oligonucleotide
uauaaaaagaaaaaaauggaaaaaa

SEQ ID NO: 6057 - RNA, 25 nt, Artificial Sequence
  Description of Artificial Sequence: Synthetic oligonucleotide
auaaaaagaaaaaaauggaaaaaaa

SEQ ID NO: 6058 - RNA, 25 nt, Artificial Sequence
  Description of Artificial Sequence: Synthetic oligonucleotide
uaaaaagaaaaaaauggaaaaaaau

SEQ ID NO: 6059 - RNA, 25 nt, Artificial Sequence
  Description of Artificial Sequence: Synthetic oligonucleotide
aaaaagaaaaaaauggaaaaaaauu

SEQ ID NO: 6060 - RNA, 25 nt, Artificial Sequence
  Description of Artificial Sequence: Synthetic oligonucleotide
aaaagaaaaaaauggaaaaaaauua

SEQ ID NO: 6061 - RNA, 25 nt, Artificial Sequence
  Description of Artificial Sequence: Synthetic oligonucleotide
aaagaaaaaaauggaaaaaaauuac

SEQ ID NO: 6062 - RNA, 25 nt, Artificial Sequence
  Description of Artificial Sequence: Synthetic oligonucleotide
aagaaaaaaauggaaaaaaauuaca

SEQ ID NO: 6063 - RNA, 25 nt, Artificial Sequence
  Description of Artificial Sequence: Synthetic oligonucleotide
aaaaaauggaaaaaaauuacaaggc

SEQ ID NO: 6064 - RNA, 25 nt, Artificial Sequence
  Description of Artificial Sequence: Synthetic oligonucleotide
aaaaauggaaaaaaauuacaaggca

SEQ ID NO: 6065 - RNA, 25 nt, Artificial Sequence
  Description of Artificial Sequence: Synthetic oligonucleotide
uggaaaaaaauuacaaggcaaugga

SEQ ID NO: 6066 - RNA, 25 nt, Artificial Sequence
  Description of Artificial Sequence: Synthetic oligonucleotide
ggaaaaaaauuacaaggcaauggaa

SEQ ID NO: 6067 - RNA, 25 nt, Artificial Sequence
  Description of Artificial Sequence: Synthetic oligonucleotide
gaaaaaaauuacaaggcaauggaaa

SEQ ID NO: 6068 - RNA, 25 nt, Artificial Sequence
  Description of Artificial Sequence: Synthetic oligonucleotide
gccauuuccuuuucacauuagauaa

SEQ ID NO: 6069 - RNA, 25 nt, Artificial Sequence
  Description of Artificial Sequence: Synthetic oligonucleotide
uccuuuucacauuagauaaauuacu

SEQ ID NO: 6070 - RNA, 25 nt, Artificial Sequence
  Description of Artificial Sequence: Synthetic oligonucleotide
cacauuagauaaauuacuauaaaga

SEQ ID NO: 6071 - RNA, 25 nt, Artificial Sequence
  Description of Artificial Sequence: Synthetic oligonucleotide
acauuagauaaauuacuauaaagac

SEQ ID NO: 6072 - RNA, 25 nt, Artificial Sequence
  Description of Artificial Sequence: Synthetic oligonucleotide
cauuagauaaauuacuauaaagacu

SEQ ID NO: 6073 - RNA, 25 nt, Artificial Sequence
  Description of Artificial Sequence: Synthetic oligonucleotide
aguaugaaauggggauuauuauagc

SEQ ID NO: 6074 - RNA, 25 nt, Artificial Sequence
  Description of Artificial Sequence: Synthetic oligonucleotide
uggggauuauuauagcaaccauuuu

SEQ ID NO: 6075 - RNA, 25 nt, Artificial Sequence
  Description of Artificial Sequence: Synthetic oligonucleotide
ggcuauauuuacaugcuacuaaauu

SEQ ID NO: 6076 - RNA, 25 nt, Artificial Sequence
  Description of Artificial Sequence: Synthetic oligonucleotide
gcuauauuuacaugcuacuaaauuu

SEQ ID NO: 6077 - RNA, 25 nt, Artificial Sequence
  Description of Artificial Sequence: Synthetic oligonucleotide
cuauauuuacaugcuacuaaauuuu

SEQ ID NO: 6078 - RNA, 25 nt, Artificial Sequence
  Description of Artificial Sequence: Synthetic oligonucleotide
uauauuuacaugcuacuaaauuuuu

SEQ ID NO: 6079 - RNA, 25 nt, Artificial Sequence
  Description of Artificial Sequence: Synthetic oligonucleotide
auauuuacaugcuacuaaauuuuua

SEQ ID NO: 6080 - RNA, 25 nt, Artificial Sequence
  Description of Artificial Sequence: Synthetic oligonucleotide
uacaugcuacuaaauuuuuauaaua

SEQ ID NO: 6081 - RNA, 25 nt, Artificial Sequence
  Description of Artificial Sequence: Synthetic oligonucleotide
uacuaaauuuuuauaauaauugaaa

SEQ ID NO: 6082 - RNA, 25 nt, Artificial Sequence
  Description of Artificial Sequence: Synthetic oligonucleotide
acuaaauuuuuauaauaauugaaaa

SEQ ID NO: 6083 - RNA, 25 nt, Artificial Sequence
  Description of Artificial Sequence: Synthetic oligonucleotide
uaaauuuuuauaauaauugaaaaga

SEQ ID NO: 6084 - RNA, 25 nt, Artificial Sequence
  Description of Artificial Sequence: Synthetic oligonucleotide
aaauuuuuauaauaauugaaaagau

SEQ ID NO: 6085 - RNA, 25 nt, Artificial Sequence
  Description of Artificial Sequence: Synthetic oligonucleotide
aauuuuuauaauaauugaaaagauu

SEQ ID NO: 6086 - RNA, 25 nt, Artificial Sequence
  Description of Artificial Sequence: Synthetic oligonucleotide
auuuuuauaauaauugaaaagauuu

SEQ ID NO: 6087 - RNA, 25 nt, Artificial Sequence
  Description of Artificial Sequence: Synthetic oligonucleotide
uuuuuauaauaauugaaaagauuuu

SEQ ID NO: 6088 - RNA, 25 nt, Artificial Sequence
  Description of Artificial Sequence: Synthetic oligonucleotide
uuuuauaauaauugaaaagauuuua

SEQ ID NO: 6089 - RNA, 25 nt, Artificial Sequence
  Description of Artificial Sequence: Synthetic oligonucleotide
uuuauaauaauugaaaagauuuuaa

SEQ ID NO: 6090 - RNA, 25 nt, Artificial Sequence
  Description of Artificial Sequence: Synthetic oligonucleotide
uuauaauaauugaaaagauuuuaac

SEQ ID NO: 6091 - RNA, 25 nt, Artificial Sequence
  Description of Artificial Sequence: Synthetic oligonucleotide
uauaauaauugaaaagauuuuaaca

SEQ ID NO: 6092 - RNA, 25 nt, Artificial Sequence
  Description of Artificial Sequence: Synthetic oligonucleotide
auaauugaaaagauuuuaacaagua

SEQ ID NO: 6093 - RNA, 25 nt, Artificial Sequence
  Description of Artificial Sequence: Synthetic oligonucleotide
uaauugaaaagauuuuaacaaguau

SEQ ID NO: 6094 - RNA, 25 nt, Artificial Sequence
  Description of Artificial Sequence: Synthetic oligonucleotide
auugaaaagauuuuaacaaguauaa

SEQ ID NO: 6095 - RNA, 25 nt, Artificial Sequence
  Description of Artificial Sequence: Synthetic oligonucleotide
uugaaaagauuuuaacaaguauaaa

SEQ ID NO: 6096 - RNA, 25 nt, Artificial Sequence
  Description of Artificial Sequence: Synthetic oligonucleotide
ugaaaagauuuuaacaaguauaaaa

SEQ ID NO: 6097 - RNA, 25 nt, Artificial Sequence
  Description of Artificial Sequence: Synthetic oligonucleotide
gaaaagauuuuaacaaguauaaaaa

SEQ ID NO: 6098 - RNA, 25 nt, Artificial Sequence
  Description of Artificial Sequence: Synthetic oligonucleotide
aaaagauuuuaacaaguauaaaaaa

SEQ ID NO: 6099 - RNA, 25 nt, Artificial Sequence
  Description of Artificial Sequence: Synthetic oligonucleotide
aaagauuuuaacaaguauaaaaaau

SEQ ID NO: 6100 - RNA, 25 nt, Artificial Sequence
  Description of Artificial Sequence: Synthetic oligonucleotide
aagauuuuaacaaguauaaaaaauu

SEQ ID NO: 6101 - RNA, 25 nt, Artificial Sequence
  Description of Artificial Sequence: Synthetic oligonucleotide
agauuuuaacaaguauaaaaaauuc

SEQ ID NO: 6102 - RNA, 25 nt, Artificial Sequence
  Description of Artificial Sequence: Synthetic oligonucleotide
gauuuuaacaaguauaaaaaauucu

SEQ ID NO: 6103 - RNA, 25 nt, Artificial Sequence
  Description of Artificial Sequence: Synthetic oligonucleotide
acaaguauaaaaaauucucauagga

SEQ ID NO: 6104 - RNA, 25 nt, Artificial Sequence
  Description of Artificial Sequence: Synthetic oligonucleotide
caaguauaaaaaauucucauaggaa

SEQ ID NO: 6105 - RNA, 25 nt, Artificial Sequence
  Description of Artificial Sequence: Synthetic oligonucleotide
aaguauaaaaaauucucauaggaau

SEQ ID NO: 6106 - RNA, 25 nt, Artificial Sequence
  Description of Artificial Sequence: Synthetic oligonucleotide
aguauaaaaaauucucauaggaauu

SEQ ID NO: 6107 - RNA, 25 nt, Artificial Sequence
  Description of Artificial Sequence: Synthetic oligonucleotide
guauaaaaaauucucauaggaauua

SEQ ID NO: 6108 - RNA, 25 nt, Artificial Sequence
  Description of Artificial Sequence: Synthetic oligonucleotide
uauaaaaaauucucauaggaauuaa

SEQ ID NO: 6109 - RNA, 25 nt, Artificial Sequence
  Description of Artificial Sequence: Synthetic oligonucleotide
auaaaaaauucucauaggaauuaaa

SEQ ID NO: 6110 - RNA, 25 nt, Artificial Sequence
  Description of Artificial Sequence: Synthetic oligonucleotide
uaaaaaauucucauaggaauuaaau

SEQ ID NO: 6111 - RNA, 25 nt, Artificial Sequence
  Description of Artificial Sequence: Synthetic oligonucleotide
aaaaauucucauaggaauuaaaugu

SEQ ID NO: 6112 - RNA, 25 nt, Artificial Sequence
  Description of Artificial Sequence: Synthetic oligonucleotide
aaaauucucauaggaauuaaaugua

SEQ ID NO: 6113 - RNA, 25 nt, Artificial Sequence
  Description of Artificial Sequence: Synthetic oligonucleotide
cucuuucauaguauaacuuuaaauc

SEQ ID NO: 6114 - RNA, 25 nt, Artificial Sequence
  Description of Artificial Sequence: Synthetic oligonucleotide
ucauaguauaacuuuaaaucuuuuc

SEQ ID NO: 6115 - RNA, 25 nt, Artificial Sequence
  Description of Artificial Sequence: Synthetic oligonucleotide
cauaguauaacuuuaaaucuuuucu

SEQ ID NO: 6116 - RNA, 25 nt, Artificial Sequence
  Description of Artificial Sequence: Synthetic oligonucleotide
uuuaaaucuuuucuucaacuugagu

SEQ ID NO: 6117 - RNA, 25 nt, Artificial Sequence
  Description of Artificial Sequence: Synthetic oligonucleotide
uuaaaucuuuucuucaacuugaguc

SEQ ID NO: 6118 - RNA, 25 nt, Artificial Sequence
  Description of Artificial Sequence: Synthetic oligonucleotide
aacuugagucuuugaagauaguuuu

SEQ ID NO: 6119 - RNA, 25 nt, Artificial Sequence
  Description of Artificial Sequence: Synthetic oligonucleotide
cuugagucuuugaagauaguuuuaa

SEQ ID NO: 6120 - RNA, 25 nt, Artificial Sequence
  Description of Artificial Sequence: Synthetic oligonucleotide
uugagucuuugaagauaguuuuaau

SEQ ID NO: 6121 - RNA, 25 nt, Artificial Sequence
  Description of Artificial Sequence: Synthetic oligonucleotide
aagauaguuuuaauucugcuuguga

SEQ ID NO: 6122 - RNA, 25 nt, Artificial Sequence
  Description of Artificial Sequence: Synthetic oligonucleotide
agauaguuuuaauucugcuugugac

SEQ ID NO: 6123 - RNA, 25 nt, Artificial Sequence
  Description of Artificial Sequence: Synthetic oligonucleotide
gauaguuuuaauucugcuugugaca

SEQ ID NO: 6124 - RNA, 25 nt, Artificial Sequence
  Description of Artificial Sequence: Synthetic oligonucleotide
ugcuugugacauuaaaagauuauuu

SEQ ID NO: 6125 - RNA, 25 nt, Artificial Sequence
  Description of Artificial Sequence: Synthetic oligonucleotide
agcauugcuuuuguuucuuaagaaa

SEQ ID NO: 6126 - RNA, 25 nt, Artificial Sequence
  Description of Artificial Sequence: Synthetic oligonucleotide
gcauugcuuuuguuucuuaagaaaa

SEQ ID NO: 6127 - RNA, 25 nt, Artificial Sequence
  Description of Artificial Sequence: Synthetic oligonucleotide
cuuuuguuucuuaagaaaacaaacu

SEQ ID NO: 6128 - RNA, 25 nt, Artificial Sequence
  Description of Artificial Sequence: Synthetic oligonucleotide
uucuuaagaaaacaaacucuuuuuu

SEQ ID NO: 6129 - RNA, 25 nt, Artificial Sequence
  Description of Artificial Sequence: Synthetic oligonucleotide
ucuuaagaaaacaaacucuuuuuua

SEQ ID NO: 6130 - RNA, 25 nt, Artificial Sequence
  Description of Artificial Sequence: Synthetic oligonucleotide
cuuaagaaaacaaacucuuuuuuaa

SEQ ID NO: 6131 - RNA, 25 nt, Artificial Sequence
  Description of Artificial Sequence: Synthetic oligonucleotide
uuaagaaaacaaacucuuuuuuaaa

SEQ ID NO: 6132 - RNA, 25 nt, Artificial Sequence
  Description of Artificial Sequence: Synthetic oligonucleotide
uaagaaaacaaacucuuuuuuaaaa

SEQ ID NO: 6133 - RNA, 25 nt, Artificial Sequence
  Description of Artificial Sequence: Synthetic oligonucleotide
aagaaaacaaacucuuuuuuaaaaa

SEQ ID NO: 6134 - RNA, 25 nt, Artificial Sequence
  Description of Artificial Sequence: Synthetic oligonucleotide
agaaaacaaacucuuuuuuaaaaau

SEQ ID NO: 6135 - RNA, 25 nt, Artificial Sequence
  Description of Artificial Sequence: Synthetic oligonucleotide
aacaaacucuuuuuuaaaaauuacu

SEQ ID NO: 6136 - RNA, 25 nt, Artificial Sequence
  Description of Artificial Sequence: Synthetic oligonucleotide
cucuuuuuuaaaaauuacuuuuaaa

SEQ ID NO: 6137 - RNA, 25 nt, Artificial Sequence
  Description of Artificial Sequence: Synthetic oligonucleotide
ucuuuuuuaaaaauuacuuuuaaau

SEQ ID NO: 6138 - RNA, 25 nt, Artificial Sequence
  Description of Artificial Sequence: Synthetic oligonucleotide
cuuuuuuaaaaauuacuuuuaaaua

SEQ ID NO: 6139 - RNA, 25 nt, Artificial Sequence
  Description of Artificial Sequence: Synthetic oligonucleotide
uuuuuuaaaaauuacuuuuaaauau

SEQ ID NO: 6140 - RNA, 25 nt, Artificial Sequence
  Description of Artificial Sequence: Synthetic oligonucleotide
uuuuuaaaaauuacuuuuaaauauu

SEQ ID NO: 6141 - RNA, 25 nt, Artificial Sequence
  Description of Artificial Sequence: Synthetic oligonucleotide
uuuuaaaaauuacuuuuaaauauua

SEQ ID NO: 6142 - RNA, 25 nt, Artificial Sequence
  Description of Artificial Sequence: Synthetic oligonucleotide
uuuaaaaauuacuuuuaaauauuaa

SEQ ID NO: 6143 - RNA, 25 nt, Artificial Sequence
  Description of Artificial Sequence: Synthetic oligonucleotide
uuaaaaauuacuuuuaaauauuaac

SEQ ID NO: 6144 - RNA, 25 nt, Artificial Sequence
  Description of Artificial Sequence: Synthetic oligonucleotide
uaaaaauuacuuuuaaauauuaacu

SEQ ID NO: 6145 - RNA, 25 nt, Artificial Sequence
  Description of Artificial Sequence: Synthetic oligonucleotide
uacuuuuaaauauuaacucaaaagu

SEQ ID NO: 6146 - RNA, 25 nt, Artificial Sequence
  Description of Artificial Sequence: Synthetic oligonucleotide
acuuuuaaauauuaacucaaaaguu

SEQ ID NO: 6147 - RNA, 25 nt, Artificial Sequence
  Description of Artificial Sequence: Synthetic oligonucleotide
uuuuaaauauuaacucaaaaguuga

SEQ ID NO: 6148 - RNA, 25 nt, Artificial Sequence
  Description of Artificial Sequence: Synthetic oligonucleotide
uuaaauauuaacucaaaaguugaga

SEQ ID NO: 6149 - RNA, 25 nt, Artificial Sequence
  Description of Artificial Sequence: Synthetic oligonucleotide
uaaauauuaacucaaaaguugagau

SEQ ID NO: 6150 - RNA, 25 nt, Artificial Sequence
  Description of Artificial Sequence: Synthetic oligonucleotide
aaauauuaacucaaaaguugagauu

SEQ ID NO: 6151 - RNA, 25 nt, Artificial Sequence
  Description of Artificial Sequence: Synthetic oligonucleotide
aauauuaacucaaaaguugagauuu

SEQ ID NO: 6152 - RNA, 25 nt, Artificial Sequence
  Description of Artificial Sequence: Synthetic oligonucleotide
ggugugccaagacauuaauuuuuuu

SEQ ID NO: 6153 - RNA, 25 nt, Artificial Sequence
  Description of Artificial Sequence: Synthetic oligonucleotide
gccaagacauuaauuuuuuuuuuaa

SEQ ID NO: 6154 - RNA, 25 nt, Artificial Sequence
  Description of Artificial Sequence: Synthetic oligonucleotide
ccaagacauuaauuuuuuuuuuaaa

SEQ ID NO: 6155 - RNA, 25 nt, Artificial Sequence
  Description of Artificial Sequence: Synthetic oligonucleotide
cauuaauuuuuuuuuuaaacaauga

SEQ ID NO: 6156 - RNA, 25 nt, Artificial Sequence
  Description of Artificial Sequence: Synthetic oligonucleotide
auuaauuuuuuuuuuaaacaaugaa

SEQ ID NO: 6157 - RNA, 25 nt, Artificial Sequence
  Description of Artificial Sequence: Synthetic oligonucleotide
uaauuuuuuuuuuaaacaaugaagu

SEQ ID NO: 6158 - RNA, 25 nt, Artificial Sequence
  Description of Artificial Sequence: Synthetic oligonucleotide
auuuuuuuuuuaaacaaugaaguga

SEQ ID NO: 6159 - RNA, 25 nt, Artificial Sequence
  Description of Artificial Sequence: Synthetic oligonucleotide
uuuuuuuuuuaaacaaugaagugaa

SEQ ID NO: 6160 - RNA, 25 nt, Artificial Sequence
  Description of Artificial Sequence: Synthetic oligonucleotide
uuuuuuuuuaaacaaugaagugaaa

SEQ ID NO: 6161 - RNA, 25 nt, Artificial Sequence
  Description of Artificial Sequence: Synthetic oligonucleotide
uuuuuuuuaaacaaugaagugaaaa

SEQ ID NO: 6162 - RNA, 25 nt, Artificial Sequence
  Description of Artificial Sequence: Synthetic oligonucleotide
uuuuuuuaaacaaugaagugaaaaa

SEQ ID NO: 6163 - RNA, 25 nt, Artificial Sequence
  Description of Artificial Sequence: Synthetic oligonucleotide
uuuuuaaacaaugaagugaaaaagu

SEQ ID NO: 6164 - RNA, 25 nt, Artificial Sequence
  Description of Artificial Sequence: Synthetic oligonucleotide
uuuuaaacaaugaagugaaaaaguu

SEQ ID NO: 6165 - RNA, 25 nt, Artificial Sequence
  Description of Artificial Sequence: Synthetic oligonucleotide
uuuaaacaaugaagugaaaaaguuu

SEQ ID NO: 6166 - RNA, 25 nt, Artificial Sequence
  Description of Artificial Sequence: Synthetic oligonucleotide
augaagugaaaaaguuuuacaaucu

SEQ ID NO: 6167 - RNA, 25 nt, Artificial Sequence
  Description of Artificial Sequence: Synthetic oligonucleotide
ugaaaaaguuuuacaaucucuaggu

SEQ ID NO: 6168 - RNA, 25 nt, Artificial Sequence
  Description of Artificial Sequence: Synthetic oligonucleotide
gaaaaaguuuuacaaucucuagguu

SEQ ID NO: 6169 - RNA, 25 nt, Artificial Sequence
  Description of Artificial Sequence: Synthetic oligonucleotide
aaaaaguuuuacaaucucuagguuu

SEQ ID NO: 6170 - RNA, 25 nt, Artificial Sequence
  Description of Artificial Sequence: Synthetic oligonucleotide
acugguuaaauuaacauugcauaaa

SEQ ID NO: 6171 - RNA, 25 nt, Artificial Sequence
  Description of Artificial Sequence: Synthetic oligonucleotide
cugguuaaauuaacauugcauaaac

SEQ ID NO: 6172 - RNA, 25 nt, Artificial Sequence
  Description of Artificial Sequence: Synthetic oligonucleotide
ugguuaaauuaacauugcauaaaca

SEQ ID NO: 6173 - RNA, 25 nt, Artificial Sequence
  Description of Artificial Sequence: Synthetic oligonucleotide
acauugcauaaacacuuuucaaguc

SEQ ID NO: 6174 - RNA, 25 nt, Artificial Sequence
  Description of Artificial Sequence: Synthetic oligonucleotide
ucaagucugauccauauuuaauaau

SEQ ID NO: 6175 - RNA, 25 nt, Artificial Sequence
  Description of Artificial Sequence: Synthetic oligonucleotide
uccauauuuaauaaugcuuuaaaau

SEQ ID NO: 6176 - RNA, 25 nt, Artificial Sequence
  Description of Artificial Sequence: Synthetic oligonucleotide
ccauauuuaauaaugcuuuaaaaua

SEQ ID NO: 6177 - RNA, 25 nt, Artificial Sequence
  Description of Artificial Sequence: Synthetic oligonucleotide
cauauuuaauaaugcuuuaaaauaa

SEQ ID NO: 6178 - RNA, 25 nt, Artificial Sequence
  Description of Artificial Sequence: Synthetic oligonucleotide
auauuuaauaaugcuuuaaaauaaa

SEQ ID NO: 6179 - RNA, 25 nt, Artificial Sequence
  Description of Artificial Sequence: Synthetic oligonucleotide
uauuuaauaaugcuuuaaaauaaaa

SEQ ID NO: 6180 - RNA, 25 nt, Artificial Sequence
  Description of Artificial Sequence: Synthetic oligonucleotide
auuuaauaaugcuuuaaaauaaaaa

SEQ ID NO: 6181 - RNA, 25 nt, Artificial Sequence
  Description of Artificial Sequence: Synthetic oligonucleotide
uuaauaaugcuuuaaaauaaaaaua

SEQ ID NO: 6182 - RNA, 25 nt, Artificial Sequence
  Description of Artificial Sequence: Synthetic oligonucleotide
uaauaaugcuuuaaaauaaaaauaa

SEQ ID NO: 6183 - RNA, 25 nt, Artificial Sequence
  Description of Artificial Sequence: Synthetic oligonucleotide
aauaaugcuuuaaaauaaaaauaaa

SEQ ID NO: 6184 - RNA, 25 nt, Artificial Sequence
  Description of Artificial Sequence: Synthetic oligonucleotide
auaaugcuuuaaaauaaaaauaaaa

SEQ ID NO: 6185 - RNA, 25 nt, Artificial Sequence
  Description of Artificial Sequence: Synthetic oligonucleotide
uuuaaaauaaaaauaaaaacaaucc

SEQ ID NO: 6186 - RNA, 25 nt, Artificial Sequence
  Description of Artificial Sequence: Synthetic oligonucleotide
auaaaaauaaaaacaauccuuuuga

SEQ ID NO: 6187 - RNA, 25 nt, Artificial Sequence
  Description of Artificial Sequence: Synthetic oligonucleotide
uaaaaauaaaaacaauccuuuugau

SEQ ID NO: 6188 - RNA, 25 nt, Artificial Sequence
  Description of Artificial Sequence: Synthetic oligonucleotide
aaaaauaaaaacaauccuuuugaua

SEQ ID NO: 6189 - RNA, 25 nt, Artificial Sequence
  Description of Artificial Sequence: Synthetic oligonucleotide
aaaauaaaaacaauccuuuugauaa

SEQ ID NO: 6190 - RNA, 25 nt, Artificial Sequence
  Description of Artificial Sequence: Synthetic oligonucleotide
aaauaaaaacaauccuuuugauaaa

SEQ ID NO: 6191 - RNA, 25 nt, Artificial Sequence
  Description of Artificial Sequence: Synthetic oligonucleotide
aauaaaaacaauccuuuugauaaau

SEQ ID NO: 6192 - RNA, 25 nt, Artificial Sequence
  Description of Artificial Sequence: Synthetic oligonucleotide
auaaaaacaauccuuuugauaaauu

SEQ ID NO: 6193 - RNA, 25 nt, Artificial Sequence
  Description of Artificial Sequence: Synthetic oligonucleotide
uaaaaacaauccuuuugauaaauuu

SEQ ID NO: 6194 - RNA, 25 nt, Artificial Sequence
  Description of Artificial Sequence: Synthetic oligonucleotide
aacaauccuuuugauaaauuuaaaa

SEQ ID NO: 6195 - RNA, 25 nt, Artificial Sequence
  Description of Artificial Sequence: Synthetic oligonucleotide
uccuuuugauaaauuuaaaauguua

SEQ ID NO: 6196 - RNA, 25 nt, Artificial Sequence
  Description of Artificial Sequence: Synthetic oligonucleotide
ccuuuugauaaauuuaaaauguuac

SEQ ID NO: 6197 - RNA, 25 nt, Artificial Sequence
  Description of Artificial Sequence: Synthetic oligonucleotide
cuuuugauaaauuuaaaauguuacu

SEQ ID NO: 6198 - RNA, 25 nt, Artificial Sequence
  Description of Artificial Sequence: Synthetic oligonucleotide
ugauaaauuuaaaauguuacuuauu

SEQ ID NO: 6199 - RNA, 25 nt, Artificial Sequence
  Description of Artificial Sequence: Synthetic oligonucleotide
gauaaauuuaaaauguuacuuauuu

SEQ ID NO: 6200 - RNA, 25 nt, Artificial Sequence
  Description of Artificial Sequence: Synthetic oligonucleotide
auaaauuuaaaauguuacuuauuuu

SEQ ID NO: 6201 - RNA, 25 nt, Artificial Sequence
  Description of Artificial Sequence: Synthetic oligonucleotide
uaaauuuaaaauguuacuuauuuua

SEQ ID NO: 6202 - RNA, 25 nt, Artificial Sequence
  Description of Artificial Sequence: Synthetic oligonucleotide
aaauuuaaaauguuacuuauuuuaa

SEQ ID NO: 6203 - RNA, 25 nt, Artificial Sequence
  Description of Artificial Sequence: Synthetic oligonucleotide
aauuuaaaauguuacuuauuuuaaa

SEQ ID NO: 6204 - RNA, 25 nt, Artificial Sequence
  Description of Artificial Sequence: Synthetic oligonucleotide
uuuaaaauguuacuuauuuuaaaau

SEQ ID NO: 6205 - RNA, 25 nt, Artificial Sequence
  Description of Artificial Sequence: Synthetic oligonucleotide
uuaaaauguuacuuauuuuaaaaua

SEQ ID NO: 6206 - RNA, 25 nt, Artificial Sequence
  Description of Artificial Sequence: Synthetic oligonucleotide
uaaaauguuacuuauuuuaaaauaa

SEQ ID NO: 6207 - RNA, 25 nt, Artificial Sequence
  Description of Artificial Sequence: Synthetic oligonucleotide
aaaauguuacuuauuuuaaaauaaa

SEQ ID NO: 6208 - RNA, 25 nt, Artificial Sequence
  Description of Artificial Sequence: Synthetic oligonucleotide
aaauguuacuuauuuuaaaauaaau

SEQ ID NO: 6209 - RNA, 25 nt, Artificial Sequence
  Description of Artificial Sequence: Synthetic oligonucleotide
auguuacuuauuuuaaaauaaauga

SEQ ID NO: 6210 - RNA, 25 nt, Artificial Sequence
  Description of Artificial Sequence: Synthetic oligonucleotide
acuuauuuuaaaauaaaugaaguga

SEQ ID NO: 6211 - RNA, 25 nt, Artificial Sequence
  Description of Artificial Sequence: Synthetic oligonucleotide
uuauuuuaaaauaaaugaagugaga

SEQ ID NO: 6212 - RNA, 25 nt, Artificial Sequence
  Description of Artificial Sequence: Synthetic oligonucleotide
uauuuuaaaauaaaugaagugagau

SEQ ID NO: 6213 - RNA, 25 nt, Artificial Sequence
  Description of Artificial Sequence: Synthetic oligonucleotide
uuuaaaauaaaugaagugagauggc

SEQ ID NO: 6214 - RNA, 25 nt, Artificial Sequence
  Description of Artificial Sequence: Synthetic oligonucleotide
uuaaaauaaaugaagugagauggca

SEQ ID NO: 6215 - RNA, 25 nt, Artificial Sequence
  Description of Artificial Sequence: Synthetic oligonucleotide
uccauuucuucauguuaaaagaagu

SEQ ID NO: 6216 - RNA, 25 nt, Artificial Sequence
  Description of Artificial Sequence: Synthetic oligonucleotide
ccauuucuucauguuaaaagaaguc

SEQ ID NO: 6217 - RNA, 25 nt, Artificial Sequence
  Description of Artificial Sequence: Synthetic oligonucleotide
cucaaacucuuaguuuuuuuuuuuu

SEQ ID NO: 6218 - RNA, 25 nt, Artificial Sequence
  Description of Artificial Sequence: Synthetic oligonucleotide
uaguuuuuuuuuuuuacaacuaugu

SEQ ID NO: 6219 - RNA, 25 nt, Artificial Sequence
  Description of Artificial Sequence: Synthetic oligonucleotide
aguuuuuuuuuuuuacaacuaugua

SEQ ID NO: 6220 - RNA, 25 nt, Artificial Sequence
  Description of Artificial Sequence: Synthetic oligonucleotide
guuuuuuuuuuuuacaacuauguaa

SEQ ID NO: 6221 - RNA, 25 nt, Artificial Sequence
  Description of Artificial Sequence: Synthetic oligonucleotide
uuuuuuuuuuuuacaacuauguaau

SEQ ID NO: 6222 - RNA, 25 nt, Artificial Sequence
  Description of Artificial Sequence: Synthetic oligonucleotide
uuuuuuuuuuuacaacuauguaauu

SEQ ID NO: 6223 - RNA, 25 nt, Artificial Sequence
  Description of Artificial Sequence: Synthetic oligonucleotide
uuuuuuuuuuacaacuauguaauuu

SEQ ID NO: 6224 - RNA, 25 nt, Artificial Sequence
  Description of Artificial Sequence: Synthetic oligonucleotide
uuuuuuuuuacaacuauguaauuua

SEQ ID NO: 6225 - RNA, 25 nt, Artificial Sequence
  Description of Artificial Sequence: Synthetic oligonucleotide
uuuuuuuuacaacuauguaauuuau

SEQ ID NO: 6226 - RNA, 25 nt, Artificial Sequence
  Description of Artificial Sequence: Synthetic oligonucleotide
uuuuuuuacaacuauguaauuuaua

SEQ ID NO: 6227 - RNA, 25 nt, Artificial Sequence
  Description of Artificial Sequence: Synthetic oligonucleotide
uuuuuuacaacuauguaauuuauau

SEQ ID NO: 6228 - RNA, 25 nt, Artificial Sequence
  Description of Artificial Sequence: Synthetic oligonucleotide
uuuuuacaacuauguaauuuauauu

SEQ ID NO: 6229 - RNA, 25 nt, Artificial Sequence
  Description of Artificial Sequence: Synthetic oligonucleotide
aacuauguaauuuauauuccauuua

SEQ ID NO: 6230 - RNA, 25 nt, Artificial Sequence
  Description of Artificial Sequence: Synthetic oligonucleotide
acuauguaauuuauauuccauuuac

SEQ ID NO: 6231 - RNA, 25 nt, Artificial Sequence
  Description of Artificial Sequence: Synthetic oligonucleotide
cuauguaauuuauauuccauuuaca

SEQ ID NO: 6232 - RNA, 25 nt, Artificial Sequence
  Description of Artificial Sequence: Synthetic oligonucleotide
aauuuauauuccauuuacauaagga

SEQ ID NO: 6233 - RNA, 25 nt, Artificial Sequence
  Description of Artificial Sequence: Synthetic oligonucleotide
auuuauauuccauuuacauaaggau

SEQ ID NO: 6234 - RNA, 25 nt, Artificial Sequence
  Description of Artificial Sequence: Synthetic oligonucleotide
uuuauauuccauuuacauaaggaua

SEQ ID NO: 6235 - RNA, 25 nt, Artificial Sequence
  Description of Artificial Sequence: Synthetic oligonucleotide
uuauauuccauuuacauaaggauac

SEQ ID NO: 6236 - RNA, 25 nt, Artificial Sequence
  Description of Artificial Sequence: Synthetic oligonucleotide
uacauaaggauacacuuauuuguca

SEQ ID NO: 6237 - RNA, 25 nt, Artificial Sequence
  Description of Artificial Sequence: Synthetic oligonucleotide
uaaggauacacuuauuugucaagcu

SEQ ID NO: 6238 - RNA, 25 nt, Artificial Sequence
  Description of Artificial Sequence: Synthetic oligonucleotide
aucuguaaauuuuuaaccuauguua

SEQ ID NO: 6239 - RNA, 25 nt, Artificial Sequence
  Description of Artificial Sequence: Synthetic oligonucleotide
ucuguaaauuuuuaaccuauguuac

SEQ ID NO: 6240 - RNA, 25 nt, Artificial Sequence
  Description of Artificial Sequence: Synthetic oligonucleotide
cuguaaauuuuuaaccuauguuaca

SEQ ID NO: 6241 - RNA, 25 nt, Artificial Sequence
  Description of Artificial Sequence: Synthetic oligonucleotide
ugcaagaggugaaguuuauauuuga

SEQ ID NO: 6242 - RNA, 25 nt, Artificial Sequence
  Description of Artificial Sequence: Synthetic oligonucleotide
caagaggugaaguuuauauuugaau

SEQ ID NO: 6243 - RNA, 25 nt, Artificial Sequence
  Description of Artificial Sequence: Synthetic oligonucleotide
aagaggugaaguuuauauuugaaua

SEQ ID NO: 6244 - RNA, 25 nt, Artificial Sequence
  Description of Artificial Sequence: Synthetic oligonucleotide
gaggugaaguuuauauuugaauauc

SEQ ID NO: 6245 - RNA, 25 nt, Artificial Sequence
  Description of Artificial Sequence: Synthetic oligonucleotide
aggugaaguuuauauuugaauaucc

SEQ ID NO: 6246 - RNA, 25 nt, Artificial Sequence
  Description of Artificial Sequence: Synthetic oligonucleotide
aaguuuauauuugaauauccauucu

SEQ ID NO: 6247 - RNA, 25 nt, Artificial Sequence
  Description of Artificial Sequence: Synthetic oligonucleotide
acuugaugcaguuuuaauacuugua

SEQ ID NO: 6248 - RNA, 25 nt, Artificial Sequence
  Description of Artificial Sequence: Synthetic oligonucleotide
uugaugcaguuuuaauacuuguaau

SEQ ID NO: 6249 - RNA, 25 nt, Artificial Sequence
  Description of Artificial Sequence: Synthetic oligonucleotide
gauuugaccuaaucacuaauuuuca

SEQ ID NO: 6250 - RNA, 25 nt, Artificial Sequence
  Description of Artificial Sequence: Synthetic oligonucleotide
accuaaucacuaauuuucagguggu

SEQ ID NO: 6251 - RNA, 25 nt, Artificial Sequence
  Description of Artificial Sequence: Synthetic oligonucleotide
caguaggauuuuucaaaccugguau

SEQ ID NO: 6252 - RNA, 25 nt, Artificial Sequence
  Description of Artificial Sequence: Synthetic oligonucleotide
aguggaaggagaauuuaauaaagau

SEQ ID NO: 6253 - RNA, 25 nt, Artificial Sequence
  Description of Artificial Sequence: Synthetic oligonucleotide
ggaaggagaauuuaauaaagauagu

SEQ ID NO: 6254 - RNA, 25 nt, Artificial Sequence
  Description of Artificial Sequence: Synthetic oligonucleotide
aaggagaauuuaauaaagauagugc

SEQ ID NO: 6255 - RNA, 25 nt, Artificial Sequence
  Description of Artificial Sequence: Synthetic oligonucleotide
aggagaauuuaauaaagauagugcu

SEQ ID NO: 6256 - RNA, 25 nt, Artificial Sequence
  Description of Artificial Sequence: Synthetic oligonucleotide
gaauuuaauaaagauagugcugaaa

SEQ ID NO: 6257 - RNA, 25 nt, Artificial Sequence
  Description of Artificial Sequence: Synthetic oligonucleotide
uccuuagguaaucuauaacuaggac

SEQ ID NO: 6258 - RNA, 25 nt, Artificial Sequence
  Description of Artificial Sequence: Synthetic oligonucleotide
ccuuagguaaucuauaacuaggacu

SEQ ID NO: 6259 - RNA, 25 nt, Artificial Sequence
  Description of Artificial Sequence: Synthetic oligonucleotide
aacaguaauacauuccauuguuuua

SEQ ID NO: 6260 - RNA, 25 nt, Artificial Sequence
  Description of Artificial Sequence: Synthetic oligonucleotide
caguaauacauuccauuguuuuagu

SEQ ID NO: 6261 - RNA, 25 nt, Artificial Sequence
  Description of Artificial Sequence: Synthetic oligonucleotide
aguaauacauuccauuguuuuagua

SEQ ID NO: 6262 - RNA, 25 nt, Artificial Sequence
  Description of Artificial Sequence: Synthetic oligonucleotide
guaauacauuccauuguuuuaguaa

SEQ ID NO: 6263 - RNA, 25 nt, Artificial Sequence
  Description of Artificial Sequence: Synthetic oligonucleotide
ccauuguuuuaguaaccagaaaucu

SEQ ID NO: 6264 - RNA, 25 nt, Artificial Sequence
  Description of Artificial Sequence: Synthetic oligonucleotide
accagaaaucuucaugcaaugaaaa

SEQ ID NO: 6265 - RNA, 25 nt, Artificial Sequence
  Description of Artificial Sequence: Synthetic oligonucleotide
uucaugcaaugaaaaauacuuuaau

SEQ ID NO: 6266 - RNA, 25 nt, Artificial Sequence
  Description of Artificial Sequence: Synthetic oligonucleotide
aaugaaaaauacuuuaauucaugaa

SEQ ID NO: 6267 - RNA, 25 nt, Artificial Sequence
  Description of Artificial Sequence: Synthetic oligonucleotide
ugaaaaauacuuuaauucaugaagc

SEQ ID NO: 6268 - RNA, 25 nt, Artificial Sequence
  Description of Artificial Sequence: Synthetic oligonucleotide
gaaaaauacuuuaauucaugaagcu

SEQ ID NO: 6269 - RNA, 25 nt, Artificial Sequence
  Description of Artificial Sequence: Synthetic oligonucleotide
uucaugaagcuuacuuuuuuuuuuu

SEQ ID NO: 6270 - RNA, 25 nt, Artificial Sequence
  Description of Artificial Sequence: Synthetic oligonucleotide
augaagcuuacuuuuuuuuuuuggu

SEQ ID NO: 6271 - RNA, 25 nt, Artificial Sequence
  Description of Artificial Sequence: Synthetic oligonucleotide
agcuuacuuuuuuuuuuugguguca

SEQ ID NO: 6272 - RNA, 25 nt, Artificial Sequence
  Description of Artificial Sequence: Synthetic oligonucleotide
uacuuuuuuuuuuuggugucagagu

SEQ ID NO: 6273 - RNA, 25 nt, Artificial Sequence
  Description of Artificial Sequence: Synthetic oligonucleotide
acuuuuuuuuuuuggugucagaguc

SEQ ID NO: 6274 - RNA, 25 nt, Artificial Sequence
  Description of Artificial Sequence: Synthetic oligonucleotide
aacuaauuuuuguauuuuuaggaga

SEQ ID NO: 6275 - RNA, 25 nt, Artificial Sequence
  Description of Artificial Sequence: Synthetic oligonucleotide
uaauuuuuguauuuuuaggagagac

SEQ ID NO: 6276 - RNA, 25 nt, Artificial Sequence
  Description of Artificial Sequence: Synthetic oligonucleotide
cucauuuauucagcaaauauuuauu

SEQ ID NO: 6277 - RNA, 25 nt, Artificial Sequence
  Description of Artificial Sequence: Synthetic oligonucleotide
cauuuauucagcaaauauuuauuga

SEQ ID NO: 6278 - RNA, 25 nt, Artificial Sequence
  Description of Artificial Sequence: Synthetic oligonucleotide
uuuauucagcaaauauuuauugagu

SEQ ID NO: 6279 - RNA, 25 nt, Artificial Sequence
  Description of Artificial Sequence: Synthetic oligonucleotide
uauuuuaguuuugcaaagaaggggu

SEQ ID NO: 6280 - RNA, 25 nt, Artificial Sequence
  Description of Artificial Sequence: Synthetic oligonucleotide
cucuauaauuguuuugcuacgauuc

SEQ ID NO: 6281 - RNA, 25 nt, Artificial Sequence
  Description of Artificial Sequence: Synthetic oligonucleotide
uacuuuauguaaaucacuucauugu

SEQ ID NO: 6282 - RNA, 25 nt, Artificial Sequence
  Description of Artificial Sequence: Synthetic oligonucleotide
acuuuauguaaaucacuucauuguu

SEQ ID NO: 6283 - RNA, 25 nt, Artificial Sequence
  Description of Artificial Sequence: Synthetic oligonucleotide
cuuuauguaaaucacuucauuguuu

SEQ ID NO: 6284 - RNA, 25 nt, Artificial Sequence
  Description of Artificial Sequence: Synthetic oligonucleotide
uuuauguaaaucacuucauuguuuu

SEQ ID NO: 6285 - RNA, 25 nt, Artificial Sequence
  Description of Artificial Sequence: Synthetic oligonucleotide
uuauguaaaucacuucauuguuuua

SEQ ID NO: 6286 - RNA, 25 nt, Artificial Sequence
  Description of Artificial Sequence: Synthetic oligonucleotide
uauguaaaucacuucauuguuuuaa

SEQ ID NO: 6287 - RNA, 25 nt, Artificial Sequence
  Description of Artificial Sequence: Synthetic oligonucleotide
auguaaaucacuucauuguuuuaaa

SEQ ID NO: 6288 - RNA, 25 nt, Artificial Sequence
  Description of Artificial Sequence: Synthetic oligonucleotide
auuguuuuaaaggaauaaacuugau

SEQ ID NO: 6289 - RNA, 25 nt, Artificial Sequence
  Description of Artificial Sequence: Synthetic oligonucleotide
uuguuuuaaaggaauaaacuugauu

SEQ ID NO: 6290 - RNA, 25 nt, Artificial Sequence
  Description of Artificial Sequence: Synthetic oligonucleotide
uuuuaaaggaauaaacuugauuaua

SEQ ID NO: 6291 - RNA, 25 nt, Artificial Sequence
  Description of Artificial Sequence: Synthetic oligonucleotide
uuuaaaggaauaaacuugauuauau

SEQ ID NO: 6292 - RNA, 25 nt, Artificial Sequence
  Description of Artificial Sequence: Synthetic oligonucleotide
uuaaaggaauaaacuugauuauauu

SEQ ID NO: 6293 - RNA, 25 nt, Artificial Sequence
  Description of Artificial Sequence: Synthetic oligonucleotide
aaaggaauaaacuugauuauauugu

SEQ ID NO: 6294 - RNA, 25 nt, Artificial Sequence
  Description of Artificial Sequence: Synthetic oligonucleotide
aaggaauaaacuugauuauauuguu

SEQ ID NO: 6295 - RNA, 25 nt, Artificial Sequence
  Description of Artificial Sequence: Synthetic oligonucleotide
aggaauaaacuugauuauauuguuu

SEQ ID NO: 6296 - RNA, 25 nt, Artificial Sequence
  Description of Artificial Sequence: Synthetic oligonucleotide
ggaauaaacuugauuauauuguuuu

SEQ ID NO: 6297 - RNA, 25 nt, Artificial Sequence
  Description of Artificial Sequence: Synthetic oligonucleotide
gaauaaacuugauuauauuguuuuu

SEQ ID NO: 6298 - RNA, 25 nt, Artificial Sequence
  Description of Artificial Sequence: Synthetic oligonucleotide
aacuugauuauauuguuuuuuuauu

SEQ ID NO: 6299 - RNA, 25 nt, Artificial Sequence
  Description of Artificial Sequence: Synthetic oligonucleotide
acuugauuauauuguuuuuuuauuu

SEQ ID NO: 6300 - RNA, 25 nt, Artificial Sequence
  Description of Artificial Sequence: Synthetic oligonucleotide
ugauuauauuguuuuuuuauuuggc

SEQ ID NO: 6301 - RNA, 25 nt, Artificial Sequence
  Description of Artificial Sequence: Synthetic oligonucleotide
auauuguuuuuuuauuuggcauaac

SEQ ID NO: 6302 - RNA, 25 nt, Artificial Sequence
  Description of Artificial Sequence: Synthetic oligonucleotide
uauuguuuuuuuauuuggcauaacu

SEQ ID NO: 6303 - RNA, 25 nt, Artificial Sequence
  Description of Artificial Sequence: Synthetic oligonucleotide
guuuuuuuauuuggcauaacuguga

SEQ ID NO: 6304 - RNA, 25 nt, Artificial Sequence
  Description of Artificial Sequence: Synthetic oligonucleotide
uuuuuuuauuuggcauaacugugau

SEQ ID NO: 6305 - RNA, 25 nt, Artificial Sequence
  Description of Artificial Sequence: Synthetic oligonucleotide
gcauaacugugauucuuuuaggaca

SEQ ID NO: 6306 - RNA, 25 nt, Artificial Sequence
  Description of Artificial Sequence: Synthetic oligonucleotide
acugugauucuuuuaggacaauuac

SEQ ID NO: 6307 - RNA, 25 nt, Artificial Sequence
  Description of Artificial Sequence: Synthetic oligonucleotide
cugugauucuuuuaggacaauuacu

SEQ ID NO: 6308 - RNA, 25 nt, Artificial Sequence
  Description of Artificial Sequence: Synthetic oligonucleotide
gguguaugucagauauucauauuga

SEQ ID NO: 6309 - RNA, 25 nt, Artificial Sequence
  Description of Artificial Sequence: Synthetic oligonucleotide
guguaugucagauauucauauugac

SEQ ID NO: 6310 - RNA, 25 nt, Artificial Sequence
  Description of Artificial Sequence: Synthetic oligonucleotide
caaauguguaauauuccaguuuucu

SEQ ID NO: 6311 - RNA, 25 nt, Artificial Sequence
  Description of Artificial Sequence: Synthetic oligonucleotide
cauaaguaauuaaaauauacuuaaa

SEQ ID NO: 6312 - RNA, 25 nt, Artificial Sequence
  Description of Artificial Sequence: Synthetic oligonucleotide
auaaguaauuaaaauauacuuaaaa

SEQ ID NO: 6313 - RNA, 25 nt, Artificial Sequence
  Description of Artificial Sequence: Synthetic oligonucleotide
uaaguaauuaaaauauacuuaaaaa

SEQ ID NO: 6314 - RNA, 25 nt, Artificial Sequence
  Description of Artificial Sequence: Synthetic oligonucleotide
aaguaauuaaaauauacuuaaaaau

SEQ ID NO: 6315 - RNA, 25 nt, Artificial Sequence
  Description of Artificial Sequence: Synthetic oligonucleotide
aguaauuaaaauauacuuaaaaauu

SEQ ID NO: 6316 - RNA, 25 nt, Artificial Sequence
  Description of Artificial Sequence: Synthetic oligonucleotide
guaauuaaaauauacuuaaaaauua

SEQ ID NO: 6317 - RNA, 25 nt, Artificial Sequence
  Description of Artificial Sequence: Synthetic oligonucleotide
uaauuaaaauauacuuaaaaauuaa

SEQ ID NO: 6318 - RNA, 25 nt, Artificial Sequence
  Description of Artificial Sequence: Synthetic oligonucleotide
aauuaaaauauacuuaaaaauuaau

SEQ ID NO: 6319 - RNA, 25 nt, Artificial Sequence
  Description of Artificial Sequence: Synthetic oligonucleotide
auuaaaauauacuuaaaaauuaaua

SEQ ID NO: 6320 - RNA, 25 nt, Artificial Sequence
  Description of Artificial Sequence: Synthetic oligonucleotide
uaaaauauacuuaaaaauuaauagu

SEQ ID NO: 6321 - RNA, 25 nt, Artificial Sequence
  Description of Artificial Sequence: Synthetic oligonucleotide
aaaauauacuuaaaaauuaauaguu

SEQ ID NO: 6322 - RNA, 25 nt, Artificial Sequence
  Description of Artificial Sequence: Synthetic oligonucleotide
aaauauacuuaaaaauuaauaguuu

SEQ ID NO: 6323 - RNA, 25 nt, Artificial Sequence
  Description of Artificial Sequence: Synthetic oligonucleotide
aauauacuuaaaaauuaauaguuuu

SEQ ID NO: 6324 - RNA, 25 nt, Artificial Sequence
  Description of Artificial Sequence: Synthetic oligonucleotide
uacuuaaaaauuaauaguuuuaucu

SEQ ID NO: 6325 - RNA, 25 nt, Artificial Sequence
  Description of Artificial Sequence: Synthetic oligonucleotide
uaaaaauuaauaguuuuaucugggu

SEQ ID NO: 6326 - RNA, 25 nt, Artificial Sequence
  Description of Artificial Sequence: Synthetic oligonucleotide
aaaaauuaauaguuuuaucugggua

SEQ ID NO: 6327 - RNA, 25 nt, Artificial Sequence
  Description of Artificial Sequence: Synthetic oligonucleotide
aaaauuaauaguuuuaucuggguac

SEQ ID NO: 6328 - RNA, 25 nt, Artificial Sequence
  Description of Artificial Sequence: Synthetic oligonucleotide
aucuggguacaaauaaacaggugcc

SEQ ID NO: 6329 - RNA, 25 nt, Artificial Sequence
  Description of Artificial Sequence: Synthetic oligonucleotide
gacaaggaaacuucuauguaaaaau

SEQ ID NO: 6330 - RNA, 25 nt, Artificial Sequence
  Description of Artificial Sequence: Synthetic oligonucleotide
acaaggaaacuucuauguaaaaauc

SEQ ID NO: 6331 - RNA, 25 nt, Artificial Sequence
  Description of Artificial Sequence: Synthetic oligonucleotide
caaggaaacuucuauguaaaaauca

SEQ ID NO: 6332 - RNA, 25 nt, Artificial Sequence
  Description of Artificial Sequence: Synthetic oligonucleotide
uucuauguaaaaaucacuaugauuu

SEQ ID NO: 6333 - RNA, 25 nt, Artificial Sequence
  Description of Artificial Sequence: Synthetic oligonucleotide
ucuauguaaaaaucacuaugauuuc

SEQ ID NO: 6334 - RNA, 25 nt, Artificial Sequence
  Description of Artificial Sequence: Synthetic oligonucleotide
cuauguaaaaaucacuaugauuucu

SEQ ID NO: 6335 - RNA, 25 nt, Artificial Sequence
  Description of Artificial Sequence: Synthetic oligonucleotide
guaaaaaucacuaugauuucugaau

SEQ ID NO: 6336 - RNA, 25 nt, Artificial Sequence
  Description of Artificial Sequence: Synthetic oligonucleotide
uaaaaaucacuaugauuucugaauu

SEQ ID NO: 6337 - RNA, 25 nt, Artificial Sequence
  Description of Artificial Sequence: Synthetic oligonucleotide
cuaugauuucugaauugcuauguga

SEQ ID NO: 6338 - RNA, 25 nt, Artificial Sequence
  Description of Artificial Sequence: Synthetic oligonucleotide
uaugauuucugaauugcuaugugaa

SEQ ID NO: 6339 - RNA, 25 nt, Artificial Sequence
  Description of Artificial Sequence: Synthetic oligonucleotide
uaugugaaacuacagaucuuuggaa

SEQ ID NO: 6340 - RNA, 25 nt, Artificial Sequence
  Description of Artificial Sequence: Synthetic oligonucleotide
augugaaacuacagaucuuuggaac

SEQ ID NO: 6341 - RNA, 25 nt, Artificial Sequence
  Description of Artificial Sequence: Synthetic oligonucleotide
aggguguuaagacuuacacaguacc

SEQ ID NO: 6342 - RNA, 25 nt, Artificial Sequence
  Description of Artificial Sequence: Synthetic oligonucleotide
uuuaggccucuugaauuuuugaugu

SEQ ID NO: 6343 - RNA, 25 nt, Artificial Sequence
  Description of Artificial Sequence: Synthetic oligonucleotide
ucuugaauuuuugauguagaugggc

SEQ ID NO: 6344 - RNA, 25 nt, Artificial Sequence
  Description of Artificial Sequence: Synthetic oligonucleotide
cuugaauuuuugauguagaugggca

SEQ ID NO: 6345 - RNA, 25 nt, Artificial Sequence
  Description of Artificial Sequence: Synthetic oligonucleotide
uagaugggcauuuuuuuaagguagu

SEQ ID NO: 6346 - RNA, 25 nt, Artificial Sequence
  Description of Artificial Sequence: Synthetic oligonucleotide
ggcauuuuuuuaagguagugguuaa

SEQ ID NO: 6347 - RNA, 25 nt, Artificial Sequence
  Description of Artificial Sequence: Synthetic oligonucleotide
agguagugguuaauuaccuuuaugu

SEQ ID NO: 6348 - RNA, 25 nt, Artificial Sequence
  Description of Artificial Sequence: Synthetic oligonucleotide
guagugguuaauuaccuuuauguga

SEQ ID NO: 6349 - RNA, 25 nt, Artificial Sequence
  Description of Artificial Sequence: Synthetic oligonucleotide
uagugguuaauuaccuuuaugugaa

SEQ ID NO: 6350 - RNA, 25 nt, Artificial Sequence
  Description of Artificial Sequence: Synthetic oligonucleotide
agugguuaauuaccuuuaugugaac

SEQ ID NO: 6351 - RNA, 25 nt, Artificial Sequence
  Description of Artificial Sequence: Synthetic oligonucleotide
gugguuaauuaccuuuaugugaacu

SEQ ID NO: 6352 - RNA, 25 nt, Artificial Sequence
  Description of Artificial Sequence: Synthetic oligonucleotide
accuuuaugugaacuuugaaugguu

SEQ ID NO: 6353 - RNA, 25 nt, Artificial Sequence
  Description of Artificial Sequence: Synthetic oligonucleotide
uaugugaacuuugaaugguuuaaca

SEQ ID NO: 6354 - RNA, 25 nt, Artificial Sequence
  Description of Artificial Sequence: Synthetic oligonucleotide
aacuuugaaugguuuaacaaaagau

SEQ ID NO: 6355 - RNA, 25 nt, Artificial Sequence
  Description of Artificial Sequence: Synthetic oligonucleotide
uugaaugguuuaacaaaagauuugu

SEQ ID NO: 6356 - RNA, 25 nt, Artificial Sequence
  Description of Artificial Sequence: Synthetic oligonucleotide
ugaaugguuuaacaaaagauuuguu

SEQ ID NO: 6357 - RNA, 25 nt, Artificial Sequence
  Description of Artificial Sequence: Synthetic oligonucleotide
gaaugguuuaacaaaagauuuguuu

SEQ ID NO: 6358 - RNA, 25 nt, Artificial Sequence
  Description of Artificial Sequence: Synthetic oligonucleotide
aaugguuuaacaaaagauuuguuuu

SEQ ID NO: 6359 - RNA, 25 nt, Artificial Sequence
  Description of Artificial Sequence: Synthetic oligonucleotide
augguuuaacaaaagauuuguuuuu

SEQ ID NO: 6360 - RNA, 25 nt, Artificial Sequence
  Description of Artificial Sequence: Synthetic oligonucleotide
gguuuaacaaaagauuuguuuuugu

SEQ ID NO: 6361 - RNA, 25 nt, Artificial Sequence
  Description of Artificial Sequence: Synthetic oligonucleotide
guuuaacaaaagauuuguuuuugua

SEQ ID NO: 6362 - RNA, 25 nt, Artificial Sequence
  Description of Artificial Sequence: Synthetic oligonucleotide
aacaaaagauuuguuuuuguagaga

SEQ ID NO: 6363 - RNA, 25 nt, Artificial Sequence
  Description of Artificial Sequence: Synthetic oligonucleotide
acaaaagauuuguuuuuguagagau

SEQ ID NO: 6364 - RNA, 25 nt, Artificial Sequence
  Description of Artificial Sequence: Synthetic oligonucleotide
caaaagauuuguuuuuguagagauu

SEQ ID NO: 6365 - RNA, 25 nt, Artificial Sequence
  Description of Artificial Sequence: Synthetic oligonucleotide
aaagauuuguuuuuguagagauuuu

SEQ ID NO: 6366 - RNA, 25 nt, Artificial Sequence
  Description of Artificial Sequence: Synthetic oligonucleotide
aagauuuguuuuuguagagauuuua

SEQ ID NO: 6367 - RNA, 25 nt, Artificial Sequence
  Description of Artificial Sequence: Synthetic oligonucleotide
agauuuguuuuuguagagauuuuaa

SEQ ID NO: 6368 - RNA, 25 nt, Artificial Sequence
  Description of Artificial Sequence: Synthetic oligonucleotide
gauuuguuuuuguagagauuuuaaa

SEQ ID NO: 6369 - RNA, 25 nt, Artificial Sequence
  Description of Artificial Sequence: Synthetic oligonucleotide
uuuuuguagagauuuuaaaggggga

SEQ ID NO: 6370 - RNA, 25 nt, Artificial Sequence
  Description of Artificial Sequence: Synthetic oligonucleotide
aagggggagaauucuagaaauaaau

SEQ ID NO: 6371 - RNA, 25 nt, Artificial Sequence
  Description of Artificial Sequence: Synthetic oligonucleotide
gggggagaauucuagaaauaaaugu

SEQ ID NO: 6372 - RNA, 25 nt, Artificial Sequence
  Description of Artificial Sequence: Synthetic oligonucleotide
ggggagaauucuagaaauaaauguu

SEQ ID NO: 6373 - RNA, 25 nt, Artificial Sequence
  Description of Artificial Sequence: Synthetic oligonucleotide
gggagaauucuagaaauaaauguua

SEQ ID NO: 6374 - RNA, 25 nt, Artificial Sequence
  Description of Artificial Sequence: Synthetic oligonucleotide
ggagaauucuagaaauaaauguuac

SEQ ID NO: 6375 - RNA, 25 nt, Artificial Sequence
  Description of Artificial Sequence: Synthetic oligonucleotide
gagaauucuagaaauaaauguuacc

SEQ ID NO: 6376 - RNA, 25 nt, Artificial Sequence
  Description of Artificial Sequence: Synthetic oligonucleotide
uucuagaaauaaauguuaccuaauu

SEQ ID NO: 6377 - RNA, 25 nt, Artificial Sequence
  Description of Artificial Sequence: Synthetic oligonucleotide
ucuagaaauaaauguuaccuaauua

SEQ ID NO: 6378 - RNA, 25 nt, Artificial Sequence
  Description of Artificial Sequence: Synthetic oligonucleotide
cuagaaauaaauguuaccuaauuau

SEQ ID NO: 6379 - RNA, 25 nt, Artificial Sequence
  Description of Artificial Sequence: Synthetic oligonucleotide
uagaaauaaauguuaccuaauuauu

SEQ ID NO: 6380 - RNA, 25 nt, Artificial Sequence
  Description of Artificial Sequence: Synthetic oligonucleotide
agaaauaaauguuaccuaauuauua

SEQ ID NO: 6381 - RNA, 25 nt, Artificial Sequence
  Description of Artificial Sequence: Synthetic oligonucleotide
aaauaaauguuaccuaauuauuaca

SEQ ID NO: 6382 - RNA, 25 nt, Artificial Sequence
  Description of Artificial Sequence: Synthetic oligonucleotide
accuaauuauuacagccuuaaagac

SEQ ID NO: 6383 - RNA, 25 nt, Artificial Sequence
  Description of Artificial Sequence: Synthetic oligonucleotide
ccuaauuauuacagccuuaaagaca

SEQ ID NO: 6384 - RNA, 25 nt, Artificial Sequence
  Description of Artificial Sequence: Synthetic oligonucleotide
ccuuaaagacaaaaauccuuguuga

SEQ ID NO: 6385 - RNA, 25 nt, Artificial Sequence
  Description of Artificial Sequence: Synthetic oligonucleotide
uaaagacaaaaauccuuguugaagu

SEQ ID NO: 6386 - RNA, 25 nt, Artificial Sequence
  Description of Artificial Sequence: Synthetic oligonucleotide
uccuuguugaaguuuuuuuaaaaaa

SEQ ID NO: 6387 - RNA, 25 nt, Artificial Sequence
  Description of Artificial Sequence: Synthetic oligonucleotide
ccuuguugaaguuuuuuuaaaaaaa

SEQ ID NO: 6388 - RNA, 25 nt, Artificial Sequence
  Description of Artificial Sequence: Synthetic oligonucleotide
uuguugaaguuuuuuuaaaaaaagc

SEQ ID NO: 6389 - RNA, 25 nt, Artificial Sequence
  Description of Artificial Sequence: Synthetic oligonucleotide
uguugaaguuuuuuuaaaaaaagcu

SEQ ID NO: 6390 - RNA, 25 nt, Artificial Sequence
  Description of Artificial Sequence: Synthetic oligonucleotide
gaaguuuuuuuaaaaaaagcuaaau

SEQ ID NO: 6391 - RNA, 25 nt, Artificial Sequence
  Description of Artificial Sequence: Synthetic oligonucleotide
aaguuuuuuuaaaaaaagcuaaauu

SEQ ID NO: 6392 - RNA, 25 nt, Artificial Sequence
  Description of Artificial Sequence: Synthetic oligonucleotide
aguuuuuuuaaaaaaagcuaaauua

SEQ ID NO: 6393 - RNA, 25 nt, Artificial Sequence
  Description of Artificial Sequence: Synthetic oligonucleotide
guuuuuuuaaaaaaagcuaaauuac

SEQ ID NO: 6394 - RNA, 25 nt, Artificial Sequence
  Description of Artificial Sequence: Synthetic oligonucleotide
uuuuuuuaaaaaaagcuaaauuaca

SEQ ID NO: 6395 - RNA, 25 nt, Artificial Sequence
  Description of Artificial Sequence: Synthetic oligonucleotide
uuuaaaaaaagcuaaauuacauaga

SEQ ID NO: 6396 - RNA, 25 nt, Artificial Sequence
  Description of Artificial Sequence: Synthetic oligonucleotide
uaaaaaaagcuaaauuacauagacu

SEQ ID NO: 6397 - RNA, 25 nt, Artificial Sequence
  Description of Artificial Sequence: Synthetic oligonucleotide
acuuaggcauuaacauguuugugga

SEQ ID NO: 6398 - RNA, 25 nt, Artificial Sequence
  Description of Artificial Sequence: Synthetic oligonucleotide
cuuaggcauuaacauguuuguggaa

SEQ ID NO: 6399 - RNA, 25 nt, Artificial Sequence
  Description of Artificial Sequence: Synthetic oligonucleotide
agcagacguauauuguaucauuuga

SEQ ID NO: 6400 - RNA, 25 nt, Artificial Sequence
  Description of Artificial Sequence: Synthetic oligonucleotide
gacguauauuguaucauuugaguga

SEQ ID NO: 6401 - RNA, 25 nt, Artificial Sequence
  Description of Artificial Sequence: Synthetic oligonucleotide
cguauauuguaucauuugagugaau

SEQ ID NO: 6402 - RNA, 25 nt, Artificial Sequence
  Description of Artificial Sequence: Synthetic oligonucleotide
auauuguaucauuugagugaauguu

SEQ ID NO: 6403 - RNA, 25 nt, Artificial Sequence
  Description of Artificial Sequence: Synthetic oligonucleotide
uauuguaucauuugagugaauguuc

SEQ ID NO: 6404 - RNA, 25 nt, Artificial Sequence
  Description of Artificial Sequence: Synthetic oligonucleotide
auuguaucauuugagugaauguucc

SEQ ID NO: 6405 - RNA, 25 nt, Artificial Sequence
  Description of Artificial Sequence: Synthetic oligonucleotide
auaggaauuuagaaccuaacuuuua

SEQ ID NO: 6406 - RNA, 25 nt, Artificial Sequence
  Description of Artificial Sequence: Synthetic oligonucleotide
uaggaauuuagaaccuaacuuuuau

SEQ ID NO: 6407 - RNA, 25 nt, Artificial Sequence
  Description of Artificial Sequence: Synthetic oligonucleotide
aauuuagaaccuaacuuuuauaggu

SEQ ID NO: 6408 - RNA, 25 nt, Artificial Sequence
  Description of Artificial Sequence: Synthetic oligonucleotide
auuuagaaccuaacuuuuauagguu

SEQ ID NO: 6409 - RNA, 25 nt, Artificial Sequence
  Description of Artificial Sequence: Synthetic oligonucleotide
uuuagaaccuaacuuuuauagguua

SEQ ID NO: 6410 - RNA, 25 nt, Artificial Sequence
  Description of Artificial Sequence: Synthetic oligonucleotide
uuagaaccuaacuuuuauagguuau

SEQ ID NO: 6411 - RNA, 25 nt, Artificial Sequence
  Description of Artificial Sequence: Synthetic oligonucleotide
uuuuauagguuaucaaaacuguugu

SEQ ID NO: 6412 - RNA, 25 nt, Artificial Sequence
  Description of Artificial Sequence: Synthetic oligonucleotide
uuauagguuaucaaaacuguuguca

SEQ ID NO: 6413 - RNA, 25 nt, Artificial Sequence
  Description of Artificial Sequence: Synthetic oligonucleotide
aauuuuguccuaauauauacauaga

SEQ ID NO: 6414 - RNA, 25 nt, Artificial Sequence
  Description of Artificial Sequence: Synthetic oligonucleotide
auuuuguccuaauauauacauagaa

SEQ ID NO: 6415 - RNA, 25 nt, Artificial Sequence
  Description of Artificial Sequence: Synthetic oligonucleotide
uuuuguccuaauauauacauagaaa

SEQ ID NO: 6416 - RNA, 25 nt, Artificial Sequence
  Description of Artificial Sequence: Synthetic oligonucleotide
ccuaauauauacauagaaacuuugu

SEQ ID NO: 6417 - RNA, 25 nt, Artificial Sequence
  Description of Artificial Sequence: Synthetic oligonucleotide
uauauacauagaaacuuuguggggc

SEQ ID NO: 6418 - RNA, 25 nt, Artificial Sequence
  Description of Artificial Sequence: Synthetic oligonucleotide
cacaaguucaucucauuuguauucc

SEQ ID NO: 6419 - RNA, 25 nt, Artificial Sequence
  Description of Artificial Sequence: Synthetic oligonucleotide
cucauuuguauuccauugauuuuuu

SEQ ID NO: 6420 - RNA, 25 nt, Artificial Sequence
  Description of Artificial Sequence: Synthetic oligonucleotide
ucauuuguauuccauugauuuuuuu

SEQ ID NO: 6421 - RNA, 25 nt, Artificial Sequence
  Description of Artificial Sequence: Synthetic oligonucleotide
cauuuguauuccauugauuuuuuuu

SEQ ID NO: 6422 - RNA, 25 nt, Artificial Sequence
  Description of Artificial Sequence: Synthetic oligonucleotide
auuuguauuccauugauuuuuuuuu

SEQ ID NO: 6423 - RNA, 25 nt, Artificial Sequence
  Description of Artificial Sequence: Synthetic oligonucleotide
uuuguauuccauugauuuuuuuuuu

SEQ ID NO: 6424 - RNA, 25 nt, Artificial Sequence
  Description of Artificial Sequence: Synthetic oligonucleotide
uuguauuccauugauuuuuuuuuuc

SEQ ID NO: 6425 - RNA, 25 nt, Artificial Sequence
  Description of Artificial Sequence: Synthetic oligonucleotide
uguauuccauugauuuuuuuuuucu

SEQ ID NO: 6426 - RNA, 25 nt, Artificial Sequence
  Description of Artificial Sequence: Synthetic oligonucleotide
cauugauuuuuuuuuucuucuaaac

SEQ ID NO: 6427 - RNA, 25 nt, Artificial Sequence
  Description of Artificial Sequence: Synthetic oligonucleotide
auugauuuuuuuuuucuucuaaaca

SEQ ID NO: 6428 - RNA, 25 nt, Artificial Sequence
  Description of Artificial Sequence: Synthetic oligonucleotide
auuuuuuuuuucuucuaaacauuuu

SEQ ID NO: 6429 - RNA, 25 nt, Artificial Sequence
  Description of Artificial Sequence: Synthetic oligonucleotide
uuuuuuuuuucuucuaaacauuuuu

SEQ ID NO: 6430 - RNA, 25 nt, Artificial Sequence
  Description of Artificial Sequence: Synthetic oligonucleotide
uuuuuuuuucuucuaaacauuuuuu

SEQ ID NO: 6431 - RNA, 25 nt, Artificial Sequence
  Description of Artificial Sequence: Synthetic oligonucleotide
uuuuuuuucuucuaaacauuuuuuc

SEQ ID NO: 6432 - RNA, 25 nt, Artificial Sequence
  Description of Artificial Sequence: Synthetic oligonucleotide
uuuuuuucuucuaaacauuuuuucu

SEQ ID NO: 6433 - RNA, 25 nt, Artificial Sequence
  Description of Artificial Sequence: Synthetic oligonucleotide
aacauuuuuucuucaaacaguauau

SEQ ID NO: 6434 - RNA, 25 nt, Artificial Sequence
  Description of Artificial Sequence: Synthetic oligonucleotide
acauuuuuucuucaaacaguauaua

SEQ ID NO: 6435 - RNA, 25 nt, Artificial Sequence
  Description of Artificial Sequence: Synthetic oligonucleotide
cauuuuuucuucaaacaguauauaa

SEQ ID NO: 6436 - RNA, 25 nt, Artificial Sequence
  Description of Artificial Sequence: Synthetic oligonucleotide
auuuuuucuucaaacaguauauaac

SEQ ID NO: 6437 - RNA, 25 nt, Artificial Sequence
  Description of Artificial Sequence: Synthetic oligonucleotide
uuuuuucuucaaacaguauauaacu

SEQ ID NO: 6438 - RNA, 25 nt, Artificial Sequence
  Description of Artificial Sequence: Synthetic oligonucleotide
uucaaacaguauauaacuuuuuuua

SEQ ID NO: 6439 - RNA, 25 nt, Artificial Sequence
  Description of Artificial Sequence: Synthetic oligonucleotide
acaguauauaacuuuuuuuagggga

SEQ ID NO: 6440 - RNA, 25 nt, Artificial Sequence
  Description of Artificial Sequence: Synthetic oligonucleotide
caguauauaacuuuuuuuaggggau

SEQ ID NO: 6441 - RNA, 25 nt, Artificial Sequence
  Description of Artificial Sequence: Synthetic oligonucleotide
aguauauaacuuuuuuuaggggauu

SEQ ID NO: 6442 - RNA, 25 nt, Artificial Sequence
  Description of Artificial Sequence: Synthetic oligonucleotide
guauauaacuuuuuuuaggggauuu

SEQ ID NO: 6443 - RNA, 25 nt, Artificial Sequence
  Description of Artificial Sequence: Synthetic oligonucleotide
aacuuuuuuuaggggauuuuuuuuu

SEQ ID NO: 6444 - RNA, 25 nt, Artificial Sequence
  Description of Artificial Sequence: Synthetic oligonucleotide
acuuuuuuuaggggauuuuuuuuua

SEQ ID NO: 6445 - RNA, 25 nt, Artificial Sequence
  Description of Artificial Sequence: Synthetic oligonucleotide
gggauuuuuuuuuagacagcaaaaa

SEQ ID NO: 6446 - RNA, 25 nt, Artificial Sequence
  Description of Artificial Sequence: Synthetic oligonucleotide
ggauuuuuuuuuagacagcaaaaac

SEQ ID NO: 6447 - RNA, 25 nt, Artificial Sequence
  Description of Artificial Sequence: Synthetic oligonucleotide
gauuuuuuuuuagacagcaaaaacu

SEQ ID NO: 6448 - RNA, 25 nt, Artificial Sequence
  Description of Artificial Sequence: Synthetic oligonucleotide
ugaagauuuccauuugucaaaaagu

SEQ ID NO: 6449 - RNA, 25 nt, Artificial Sequence
  Description of Artificial Sequence: Synthetic oligonucleotide
gaagauuuccauuugucaaaaagua

SEQ ID NO: 6450 - RNA, 25 nt, Artificial Sequence
  Description of Artificial Sequence: Synthetic oligonucleotide
aagauuuccauuugucaaaaaguaa

SEQ ID NO: 6451 - RNA, 25 nt, Artificial Sequence
  Description of Artificial Sequence: Synthetic oligonucleotide
agauuuccauuugucaaaaaguaau

SEQ ID NO: 6452 - RNA, 25 nt, Artificial Sequence
  Description of Artificial Sequence: Synthetic oligonucleotide
uccauuugucaaaaaguaaugauuu

SEQ ID NO: 6453 - RNA, 25 nt, Artificial Sequence
  Description of Artificial Sequence: Synthetic oligonucleotide
ccauuugucaaaaaguaaugauuuc

SEQ ID NO: 6454 - RNA, 25 nt, Artificial Sequence
  Description of Artificial Sequence: Synthetic oligonucleotide
cauuugucaaaaaguaaugauuucu

SEQ ID NO: 6455 - RNA, 25 nt, Artificial Sequence
  Description of Artificial Sequence: Synthetic oligonucleotide
gucaaaaaguaaugauuucuugaua

SEQ ID NO: 6456 - RNA, 25 nt, Artificial Sequence
  Description of Artificial Sequence: Synthetic oligonucleotide
ucaaaaaguaaugauuucuugauaa

SEQ ID NO: 6457 - RNA, 25 nt, Artificial Sequence
  Description of Artificial Sequence: Synthetic oligonucleotide
caaaaaguaaugauuucuugauaau

SEQ ID NO: 6458 - RNA, 25 nt, Artificial Sequence
  Description of Artificial Sequence: Synthetic oligonucleotide
aaaaaguaaugauuucuugauaauu

SEQ ID NO: 6459 - RNA, 25 nt, Artificial Sequence
  Description of Artificial Sequence: Synthetic oligonucleotide
aaaguaaugauuucuugauaauugu

SEQ ID NO: 6460 - RNA, 25 nt, Artificial Sequence
  Description of Artificial Sequence: Synthetic oligonucleotide
aguaaugauuucuugauaauugugu

SEQ ID NO: 6461 - RNA, 25 nt, Artificial Sequence
  Description of Artificial Sequence: Synthetic oligonucleotide
guaaugauuucuugauaauugugua

SEQ ID NO: 6462 - RNA, 25 nt, Artificial Sequence
  Description of Artificial Sequence: Synthetic oligonucleotide
aaugauuucuugauaauuguguagu

SEQ ID NO: 6463 - RNA, 25 nt, Artificial Sequence
  Description of Artificial Sequence: Synthetic oligonucleotide
augauuucuugauaauuguguagua

SEQ ID NO: 6464 - RNA, 25 nt, Artificial Sequence
  Description of Artificial Sequence: Synthetic oligonucleotide
uucuugauaauuguguaguaauguu

SEQ ID NO: 6465 - RNA, 25 nt, Artificial Sequence
  Description of Artificial Sequence: Synthetic oligonucleotide
ucuugauaauuguguaguaauguuu

SEQ ID NO: 6466 - RNA, 25 nt, Artificial Sequence
  Description of Artificial Sequence: Synthetic oligonucleotide
cuugauaauuguguaguaauguuuu

SEQ ID NO: 6467 - RNA, 25 nt, Artificial Sequence
  Description of Artificial Sequence: Synthetic oligonucleotide
ugauaauuguguaguaauguuuuuu

SEQ ID NO: 6468 - RNA, 25 nt, Artificial Sequence
  Description of Artificial Sequence: Synthetic oligonucleotide
uaauuguguaguaauguuuuuuaga

SEQ ID NO: 6469 - RNA, 25 nt, Artificial Sequence
  Description of Artificial Sequence: Synthetic oligonucleotide
auuguguaguaauguuuuuuagaac

SEQ ID NO: 6470 - RNA, 25 nt, Artificial Sequence
  Description of Artificial Sequence: Synthetic oligonucleotide
uuguguaguaauguuuuuuagaacc

SEQ ID NO: 6471 - RNA, 25 nt, Artificial Sequence
  Description of Artificial Sequence: Synthetic oligonucleotide
ccuuaaagcugaauuuauauuuagu

SEQ ID NO: 6472 - RNA, 25 nt, Artificial Sequence
  Description of Artificial Sequence: Synthetic oligonucleotide
uuaaagcugaauuuauauuuaguaa

SEQ ID NO: 6473 - RNA, 25 nt, Artificial Sequence
  Description of Artificial Sequence: Synthetic oligonucleotide
aauuuauauuuaguaacuucugugu

SEQ ID NO: 6474 - RNA, 25 nt, Artificial Sequence
  Description of Artificial Sequence: Synthetic oligonucleotide
auuuauauuuaguaacuucuguguu

SEQ ID NO: 6475 - RNA, 25 nt, Artificial Sequence
  Description of Artificial Sequence: Synthetic oligonucleotide
uuuauauuuaguaacuucuguguua

SEQ ID NO: 6476 - RNA, 25 nt, Artificial Sequence
  Description of Artificial Sequence: Synthetic oligonucleotide
auuuaguaacuucuguguuaauacu

SEQ ID NO: 6477 - RNA, 25 nt, Artificial Sequence
  Description of Artificial Sequence: Synthetic oligonucleotide
acugaauagcugucauaaaaugaaa

SEQ ID NO: 6478 - RNA, 25 nt, Artificial Sequence
  Description of Artificial Sequence: Synthetic oligonucleotide
cugaauagcugucauaaaaugaaac

SEQ ID NO: 6479 - RNA, 25 nt, Artificial Sequence
  Description of Artificial Sequence: Synthetic oligonucleotide
uaaaaugaaacuuucuuucuaaaga

SEQ ID NO: 6480 - RNA, 25 nt, Artificial Sequence
  Description of Artificial Sequence: Synthetic oligonucleotide
aaaaugaaacuuucuuucuaaagaa

SEQ ID NO: 6481 - RNA, 25 nt, Artificial Sequence
  Description of Artificial Sequence: Synthetic oligonucleotide
aaaugaaacuuucuuucuaaagaaa

SEQ ID NO: 6482 - RNA, 25 nt, Artificial Sequence
  Description of Artificial Sequence: Synthetic oligonucleotide
augaaacuuucuuucuaaagaaaga

SEQ ID NO: 6483 - RNA, 25 nt, Artificial Sequence
  Description of Artificial Sequence: Synthetic oligonucleotide
aacuuucuuucuaaagaaagauacu

SEQ ID NO: 6484 - RNA, 25 nt, Artificial Sequence
  Description of Artificial Sequence: Synthetic oligonucleotide
cacaugaguucuugaagaauaguca

SEQ ID NO: 6485 - RNA, 25 nt, Artificial Sequence
  Description of Artificial Sequence: Synthetic oligonucleotide
ucuugaagaauagucauaacuagau

SEQ ID NO: 6486 - RNA, 25 nt, Artificial Sequence
  Description of Artificial Sequence: Synthetic oligonucleotide
cuugaagaauagucauaacuagauu

SEQ ID NO: 6487 - RNA, 25 nt, Artificial Sequence
  Description of Artificial Sequence: Synthetic oligonucleotide
uugaagaauagucauaacuagauua

SEQ ID NO: 6488 - RNA, 25 nt, Artificial Sequence
  Description of Artificial Sequence: Synthetic oligonucleotide
aagaauagucauaacuagauuaaga

SEQ ID NO: 6489 - RNA, 25 nt, Artificial Sequence
  Description of Artificial Sequence: Synthetic oligonucleotide
agaauagucauaacuagauuaagau

SEQ ID NO: 6490 - RNA, 25 nt, Artificial Sequence
  Description of Artificial Sequence: Synthetic oligonucleotide
gaauagucauaacuagauuaagauc

SEQ ID NO: 6491 - RNA, 25 nt, Artificial Sequence
  Description of Artificial Sequence: Synthetic oligonucleotide
aauagucauaacuagauuaagaucu

SEQ ID NO: 6492 - RNA, 25 nt, Artificial Sequence
  Description of Artificial Sequence: Synthetic oligonucleotide
gucauaacuagauuaagaucugugu

SEQ ID NO: 6493 - RNA, 25 nt, Artificial Sequence
  Description of Artificial Sequence: Synthetic oligonucleotide
acuagauuaagaucuguguuuuagu

SEQ ID NO: 6494 - RNA, 25 nt, Artificial Sequence
  Description of Artificial Sequence: Synthetic oligonucleotide
uagauuaagaucuguguuuuaguuu

SEQ ID NO: 6495 - RNA, 25 nt, Artificial Sequence
  Description of Artificial Sequence: Synthetic oligonucleotide
agauuaagaucuguguuuuaguuua

SEQ ID NO: 6496 - RNA, 25 nt, Artificial Sequence
  Description of Artificial Sequence: Synthetic oligonucleotide
auuaagaucuguguuuuaguuuaau

SEQ ID NO: 6497 - RNA, 25 nt, Artificial Sequence
  Description of Artificial Sequence: Synthetic oligonucleotide
ucuguguuuuaguuuaauaguuuga

SEQ ID NO: 6498 - RNA, 25 nt, Artificial Sequence
  Description of Artificial Sequence: Synthetic oligonucleotide
cuguguuuuaguuuaauaguuugaa

SEQ ID NO: 6499 - RNA, 25 nt, Artificial Sequence
  Description of Artificial Sequence: Synthetic oligonucleotide
guguuuuaguuuaauaguuugaagu

SEQ ID NO: 6500 - RNA, 25 nt, Artificial Sequence
  Description of Artificial Sequence: Synthetic oligonucleotide
guuuuaguuuaauaguuugaagugc

SEQ ID NO: 6501 - RNA, 25 nt, Artificial Sequence
  Description of Artificial Sequence: Synthetic oligonucleotide
uuuuaguuuaauaguuugaagugcc

SEQ ID NO: 6502 - RNA, 25 nt, Artificial Sequence
  Description of Artificial Sequence: Synthetic oligonucleotide
guuugggauaaugauagguaauuua

SEQ ID NO: 6503 - RNA, 25 nt, Artificial Sequence
  Description of Artificial Sequence: Synthetic oligonucleotide
uugggauaaugauagguaauuuaga

SEQ ID NO: 6504 - RNA, 25 nt, Artificial Sequence
  Description of Artificial Sequence: Synthetic oligonucleotide
ggauaaugauagguaauuuagauga

SEQ ID NO: 6505 - RNA, 25 nt, Artificial Sequence
  Description of Artificial Sequence: Synthetic oligonucleotide
gauaaugauagguaauuuagaugaa

SEQ ID NO: 6506 - RNA, 25 nt, Artificial Sequence
  Description of Artificial Sequence: Synthetic oligonucleotide
aaugauagguaauuuagaugaauuu

SEQ ID NO: 6507 - RNA, 25 nt, Artificial Sequence
  Description of Artificial Sequence: Synthetic oligonucleotide
augauagguaauuuagaugaauuua

SEQ ID NO: 6508 - RNA, 25 nt, Artificial Sequence
  Description of Artificial Sequence: Synthetic oligonucleotide
agguaauuuagaugaauuuagggga

SEQ ID NO: 6509 - RNA, 25 nt, Artificial Sequence
  Description of Artificial Sequence: Synthetic oligonucleotide
guaauuuagaugaauuuaggggaaa

SEQ ID NO: 6510 - RNA, 25 nt, Artificial Sequence
  Description of Artificial Sequence: Synthetic oligonucleotide
agaugaauuuaggggaaaaaaaagu

SEQ ID NO: 6511 - RNA, 25 nt, Artificial Sequence
  Description of Artificial Sequence: Synthetic oligonucleotide
gaugaauuuaggggaaaaaaaaguu

SEQ ID NO: 6512 - RNA, 25 nt, Artificial Sequence
  Description of Artificial Sequence: Synthetic oligonucleotide
gggaaaaaaaaguuaucugcagaua

SEQ ID NO: 6513 - RNA, 25 nt, Artificial Sequence
  Description of Artificial Sequence: Synthetic oligonucleotide
ggaaaaaaaaguuaucugcagauau

SEQ ID NO: 6514 - RNA, 25 nt, Artificial Sequence
  Description of Artificial Sequence: Synthetic oligonucleotide
aaaaaguuaucugcagauauguuga

SEQ ID NO: 6515 - RNA, 25 nt, Artificial Sequence
  Description of Artificial Sequence: Synthetic oligonucleotide
gucuuguguuuucauguugaaaaua

SEQ ID NO: 6516 - RNA, 25 nt, Artificial Sequence
  Description of Artificial Sequence: Synthetic oligonucleotide
ucuuguguuuucauguugaaaauac

SEQ ID NO: 6517 - RNA, 25 nt, Artificial Sequence
  Description of Artificial Sequence: Synthetic oligonucleotide
cuuguguuuucauguugaaaauacu

SEQ ID NO: 6518 - RNA, 25 nt, Artificial Sequence
  Description of Artificial Sequence: Synthetic oligonucleotide
cauguugaaaauacuuuugcauuuu

SEQ ID NO: 6519 - RNA, 25 nt, Artificial Sequence
  Description of Artificial Sequence: Synthetic oligonucleotide
auguugaaaauacuuuugcauuuuu

SEQ ID NO: 6520 - RNA, 25 nt, Artificial Sequence
  Description of Artificial Sequence: Synthetic oligonucleotide
uguugaaaauacuuuugcauuuuuc

SEQ ID NO: 6521 - RNA, 25 nt, Artificial Sequence
  Description of Artificial Sequence: Synthetic oligonucleotide
guugaaaauacuuuugcauuuuucc

SEQ ID NO: 6522 - RNA, 25 nt, Artificial Sequence
  Description of Artificial Sequence: Synthetic oligonucleotide
cuuuugcauuuuuccuuugagugcc

SEQ ID NO: 6523 - RNA, 25 nt, Artificial Sequence
  Description of Artificial Sequence: Synthetic oligonucleotide
ugagugccaauuucuuacuaguacu

SEQ ID NO: 6524 - RNA, 25 nt, Artificial Sequence
  Description of Artificial Sequence: Synthetic oligonucleotide
gccaauuucuuacuaguacuauuuc

SEQ ID NO: 6525 - RNA, 25 nt, Artificial Sequence
  Description of Artificial Sequence: Synthetic oligonucleotide
ccaauuucuuacuaguacuauuucu

SEQ ID NO: 6526 - RNA, 25 nt, Artificial Sequence
  Description of Artificial Sequence: Synthetic oligonucleotide
uacuaguacuauuucuuaauguaac

SEQ ID NO: 6527 - RNA, 25 nt, Artificial Sequence
  Description of Artificial Sequence: Synthetic oligonucleotide
acuaguacuauuucuuaauguaaca

SEQ ID NO: 6528 - RNA, 25 nt, Artificial Sequence
  Description of Artificial Sequence: Synthetic oligonucleotide
uacuauuucuuaauguaacauguuu

SEQ ID NO: 6529 - RNA, 25 nt, Artificial Sequence
  Description of Artificial Sequence: Synthetic oligonucleotide
acuauuucuuaauguaacauguuua

SEQ ID NO: 6530 - RNA, 25 nt, Artificial Sequence
  Description of Artificial Sequence: Synthetic oligonucleotide
cuauuucuuaauguaacauguuuac

SEQ ID NO: 6531 - RNA, 25 nt, Artificial Sequence
  Description of Artificial Sequence: Synthetic oligonucleotide
uuaauguaacauguuuaccuggaau

SEQ ID NO: 6532 - RNA, 25 nt, Artificial Sequence
  Description of Artificial Sequence: Synthetic oligonucleotide
ccuggaauguauuuuaacuauuuuu

SEQ ID NO: 6533 - RNA, 25 nt, Artificial Sequence
  Description of Artificial Sequence: Synthetic oligonucleotide
uggaauguauuuuaacuauuuuugu

SEQ ID NO: 6534 - RNA, 25 nt, Artificial Sequence
  Description of Artificial Sequence: Synthetic oligonucleotide
ggaauguauuuuaacuauuuuugua

SEQ ID NO: 6535 - RNA, 25 nt, Artificial Sequence
  Description of Artificial Sequence: Synthetic oligonucleotide
gaauguauuuuaacuauuuuuguau

SEQ ID NO: 6536 - RNA, 25 nt, Artificial Sequence
  Description of Artificial Sequence: Synthetic oligonucleotide
aauguauuuuaacuauuuuuguaua

SEQ ID NO: 6537 - RNA, 25 nt, Artificial Sequence
  Description of Artificial Sequence: Synthetic oligonucleotide
uguauuuuaacuauuuuuguauagu

SEQ ID NO: 6538 - RNA, 25 nt, Artificial Sequence
  Description of Artificial Sequence: Synthetic oligonucleotide
uauuuuaacuauuuuuguauagugu

SEQ ID NO: 6539 - RNA, 25 nt, Artificial Sequence
  Description of Artificial Sequence: Synthetic oligonucleotide
auuuuaacuauuuuuguauagugua

SEQ ID NO: 6540 - RNA, 25 nt, Artificial Sequence
  Description of Artificial Sequence: Synthetic oligonucleotide
uuuuaacuauuuuuguauaguguaa

SEQ ID NO: 6541 - RNA, 25 nt, Artificial Sequence
  Description of Artificial Sequence: Synthetic oligonucleotide
uauuuuuguauaguguaaacugaaa

SEQ ID NO: 6542 - RNA, 25 nt, Artificial Sequence
  Description of Artificial Sequence: Synthetic oligonucleotide
auuuuuguauaguguaaacugaaac

SEQ ID NO: 6543 - RNA, 25 nt, Artificial Sequence
  Description of Artificial Sequence: Synthetic oligonucleotide
uuuuuguauaguguaaacugaaaca

SEQ ID NO: 6544 - RNA, 25 nt, Artificial Sequence
  Description of Artificial Sequence: Synthetic oligonucleotide
aacugaaacaugcacauuuuguaca

SEQ ID NO: 6545 - RNA, 25 nt, Artificial Sequence
  Description of Artificial Sequence: Synthetic oligonucleotide
aacaugcacauuuuguacauugugc

SEQ ID NO: 6546 - RNA, 25 nt, Artificial Sequence
  Description of Artificial Sequence: Synthetic oligonucleotide
uccaguuguuuuccaucauuugguu

SEQ ID NO: 6547 - RNA, 25 nt, Artificial Sequence
  Description of Artificial Sequence: Synthetic oligonucleotide
caguuguuuuccaucauuugguugc

SEQ ID NO: 6548 - RNA, 25 nt, Artificial Sequence
  Description of Artificial Sequence: Synthetic oligonucleotide
auguuggucauaucaaacauuaaaa

SEQ ID NO: 6549 - RNA, 25 nt, Artificial Sequence
  Description of Artificial Sequence: Synthetic oligonucleotide
uguuggucauaucaaacauuaaaaa

SEQ ID NO: 6550 - RNA, 25 nt, Artificial Sequence
  Description of Artificial Sequence: Synthetic oligonucleotide
guuggucauaucaaacauuaaaaau

SEQ ID NO: 6551 - RNA, 25 nt, Artificial Sequence
  Description of Artificial Sequence: Synthetic oligonucleotide
gucauaucaaacauuaaaaaugacc

SEQ ID NO: 6552 - RNA, 25 nt, Artificial Sequence
  Description of Artificial Sequence: Synthetic oligonucleotide
aaaaugaccacucuuuuaauugaaa

SEQ ID NO: 6553 - RNA, 25 nt, Artificial Sequence
  Description of Artificial Sequence: Synthetic oligonucleotide
aaaugaccacucuuuuaauugaaau

SEQ ID NO: 6554 - RNA, 25 nt, Artificial Sequence
  Description of Artificial Sequence: Synthetic oligonucleotide
cucuuuuaauugaaauuaacuuuua

SEQ ID NO: 6555 - RNA, 25 nt, Artificial Sequence
  Description of Artificial Sequence: Synthetic oligonucleotide
ucuuuuaauugaaauuaacuuuuaa

SEQ ID NO: 6556 - RNA, 25 nt, Artificial Sequence
  Description of Artificial Sequence: Synthetic oligonucleotide
uuuuaauugaaauuaacuuuuaaau

SEQ ID NO: 6557 - RNA, 25 nt, Artificial Sequence
  Description of Artificial Sequence: Synthetic oligonucleotide
uuaauugaaauuaacuuuuaaaugu

SEQ ID NO: 6558 - RNA, 25 nt, Artificial Sequence
  Description of Artificial Sequence: Synthetic oligonucleotide
uaauugaaauuaacuuuuaaauguu

SEQ ID NO: 6559 - RNA, 25 nt, Artificial Sequence
  Description of Artificial Sequence: Synthetic oligonucleotide
aauugaaauuaacuuuuaaauguuu

SEQ ID NO: 6560 - RNA, 25 nt, Artificial Sequence
  Description of Artificial Sequence: Synthetic oligonucleotide
auugaaauuaacuuuuaaauguuua

SEQ ID NO: 6561 - RNA, 25 nt, Artificial Sequence
  Description of Artificial Sequence: Synthetic oligonucleotide
uugaaauuaacuuuuaaauguuuau

SEQ ID NO: 6562 - RNA, 25 nt, Artificial Sequence
  Description of Artificial Sequence: Synthetic oligonucleotide
ugaaauuaacuuuuaaauguuuaua

SEQ ID NO: 6563 - RNA, 25 nt, Artificial Sequence
  Description of Artificial Sequence: Synthetic oligonucleotide
aauuaacuuuuaaauguuuauagga

SEQ ID NO: 6564 - RNA, 25 nt, Artificial Sequence
  Description of Artificial Sequence: Synthetic oligonucleotide
aacuuuuaaauguuuauaggaguau

SEQ ID NO: 6565 - RNA, 25 nt, Artificial Sequence
  Description of Artificial Sequence: Synthetic oligonucleotide
uuuaaauguuuauaggaguaugugc

SEQ ID NO: 6566 - RNA, 25 nt, Artificial Sequence
  Description of Artificial Sequence: Synthetic oligonucleotide
uuaaauguuuauaggaguaugugcu

SEQ ID NO: 6567 - RNA, 25 nt, Artificial Sequence
  Description of Artificial Sequence: Synthetic oligonucleotide
gcugugaagugaucuaaaauuugua

SEQ ID NO: 6568 - RNA, 25 nt, Artificial Sequence
  Description of Artificial Sequence: Synthetic oligonucleotide
ugugaagugaucuaaaauuuguaau

SEQ ID NO: 6569 - RNA, 25 nt, Artificial Sequence
  Description of Artificial Sequence: Synthetic oligonucleotide
gugaagugaucuaaaauuuguaaua

SEQ ID NO: 6570 - RNA, 25 nt, Artificial Sequence
  Description of Artificial Sequence: Synthetic oligonucleotide
ugaagugaucuaaaauuuguaauau

SEQ ID NO: 6571 - RNA, 25 nt, Artificial Sequence
  Description of Artificial Sequence: Synthetic oligonucleotide
gaagugaucuaaaauuuguaauauu

SEQ ID NO: 6572 - RNA, 25 nt, Artificial Sequence
  Description of Artificial Sequence: Synthetic oligonucleotide
aagugaucuaaaauuuguaauauuu

SEQ ID NO: 6573 - RNA, 25 nt, Artificial Sequence
  Description of Artificial Sequence: Synthetic oligonucleotide
agugaucuaaaauuuguaauauuuu

SEQ ID NO: 6574 - RNA, 25 nt, Artificial Sequence
  Description of Artificial Sequence: Synthetic oligonucleotide
aucuaaaauuuguaauauuuuuguc

SEQ ID NO: 6575 - RNA, 25 nt, Artificial Sequence
  Description of Artificial Sequence: Synthetic oligonucleotide
ucuaaaauuuguaauauuuuuguca

SEQ ID NO: 6576 - RNA, 25 nt, Artificial Sequence
  Description of Artificial Sequence: Synthetic oligonucleotide
aaauuuguaauauuuuugucaugaa

SEQ ID NO: 6577 - RNA, 25 nt, Artificial Sequence
  Description of Artificial Sequence: Synthetic oligonucleotide
aauuuguaauauuuuugucaugaac

SEQ ID NO: 6578 - RNA, 25 nt, Artificial Sequence
  Description of Artificial Sequence: Synthetic oligonucleotide
auuuguaauauuuuugucaugaacu

SEQ ID NO: 6579 - RNA, 25 nt, Artificial Sequence
  Description of Artificial Sequence: Synthetic oligonucleotide
guaauauuuuugucaugaacuguac

SEQ ID NO: 6580 - RNA, 25 nt, Artificial Sequence
  Description of Artificial Sequence: Synthetic oligonucleotide
uaauauuuuugucaugaacuguacu

SEQ ID NO: 6581 - RNA, 25 nt, Artificial Sequence
  Description of Artificial Sequence: Synthetic oligonucleotide
aacuguacuacuccuaauuauugua

SEQ ID NO: 6582 - RNA, 25 nt, Artificial Sequence
  Description of Artificial Sequence: Synthetic oligonucleotide
acuguacuacuccuaauuauuguaa

SEQ ID NO: 6583 - RNA, 25 nt, Artificial Sequence
  Description of Artificial Sequence: Synthetic oligonucleotide
uccuaauuauuguaauguaauaaaa

SEQ ID NO: 6584 - RNA, 25 nt, Artificial Sequence
  Description of Artificial Sequence: Synthetic oligonucleotide
ccuaauuauuguaauguaauaaaaa

SEQ ID NO: 6585 - RNA, 25 nt, Artificial Sequence
  Description of Artificial Sequence: Synthetic oligonucleotide
uaauuauuguaauguaauaaaaaua

SEQ ID NO: 6586 - RNA, 25 nt, Artificial Sequence
  Description of Artificial Sequence: Synthetic oligonucleotide
auuauuguaauguaauaaaaauagu

SEQ ID NO: 6587 - RNA, 25 nt, Artificial Sequence
  Description of Artificial Sequence: Synthetic oligonucleotide
uuauuguaauguaauaaaaauaguu

SEQ ID NO: 6588 - RNA, 25 nt, Artificial Sequence
  Description of Artificial Sequence: Synthetic oligonucleotide
auuguaauguaauaaaaauaguuac

SEQ ID NO: 6589 - RNA, 25 nt, Artificial Sequence
  Description of Artificial Sequence: Synthetic oligonucleotide
uuguaauguaauaaaaauaguuaca

SEQ ID NO: 6590 - RNA, 25 nt, Artificial Sequence
  Description of Artificial Sequence: Synthetic oligonucleotide
aauguaauaaaaauaguuacaguga

SEQ ID NO: 6591 - RNA, 25 nt, Artificial Sequence
  Description of Artificial Sequence: Synthetic oligonucleotide
auguaauaaaaauaguuacagugac

SEQ ID NO: 6592 - RNA, 25 nt, Artificial Sequence
  Description of Artificial Sequence: Synthetic oligonucleotide
uguaauaaaaauaguuacagugaca

SEQ ID NO: 6593 - RNA, 25 nt, Artificial Sequence
  Description of Artificial Sequence: Synthetic oligonucleotide
aaauaguuacagugacaaaaaaaaa

SEQ ID NO: 6594 - RNA, 25 nt, Artificial Sequence
  Description of Artificial Sequence: Synthetic oligonucleotide
aauaguuacagugacaaaaaaaaaa

SEQ ID NO: 6595 - RNA, 25 nt, Artificial Sequence
  Description of Artificial Sequence: Synthetic oligonucleotide
uaguuacagugacaaaaaaaaaaaa

SEQ ID NO: 6596 - RNA, 25 nt, Artificial Sequence
  Description of Artificial Sequence: Synthetic oligonucleotide
gaggccugcugaaaaugacugaaua

SEQ ID NO: 6597 - RNA, 25 nt, Artificial Sequence
  Description of Artificial Sequence: Synthetic oligonucleotide
aggccugcugaaaaugacugaauau

SEQ ID NO: 6598 - RNA, 25 nt, Artificial Sequence
  Description of Artificial Sequence: Synthetic oligonucleotide
ggccugcugaaaaugacugaauaua

SEQ ID NO: 6599 - RNA, 25 nt, Artificial Sequence
  Description of Artificial Sequence: Synthetic oligonucleotide
gccugcugaaaaugacugaauauaa

SEQ ID NO: 6600 - RNA, 25 nt, Artificial Sequence
  Description of Artificial Sequence: Synthetic oligonucleotide
guuggagcugguggcguaggcaaga

SEQ ID NO: 6601 - RNA, 25 nt, Artificial Sequence
  Description of Artificial Sequence: Synthetic oligonucleotide
uuggagcugguggcguaggcaagag

SEQ ID NO: 6602 - RNA, 25 nt, Artificial Sequence
  Description of Artificial Sequence: Synthetic oligonucleotide
uggagcugguggcguaggcaagagu

SEQ ID NO: 6603 - RNA, 25 nt, Artificial Sequence
  Description of Artificial Sequence: Synthetic oligonucleotide
ggagcugguggcguaggcaagagug

SEQ ID NO: 6604 - RNA, 25 nt, Artificial Sequence
  Description of Artificial Sequence: Synthetic oligonucleotide
gagcugguggcguaggcaagagugc

SEQ ID NO: 6605 - RNA, 25 nt, Artificial Sequence
  Description of Artificial Sequence: Synthetic oligonucleotide
agcugguggcguaggcaagagugcc

SEQ ID NO: 6606 - RNA, 25 nt, Artificial Sequence
  Description of Artificial Sequence: Synthetic oligonucleotide
gcugguggcguaggcaagagugccu

SEQ ID NO: 6607 - RNA, 25 nt, Artificial Sequence
  Description of Artificial Sequence: Synthetic oligonucleotide
uacagcuaauucagaaucauuuugu

SEQ ID NO: 6608 - RNA, 25 nt, Artificial Sequence
  Description of Artificial Sequence: Synthetic oligonucleotide
uaauugauggagaaaccugucucuu

SEQ ID NO: 6609 - RNA, 25 nt, Artificial Sequence
  Description of Artificial Sequence: Synthetic oligonucleotide
aauugauggagaaaccugucucuug

SEQ ID NO: 6610 - RNA, 25 nt, Artificial Sequence
  Description of Artificial Sequence: Synthetic oligonucleotide
gauggagaaaccugucucuuggaua

SEQ ID NO: 6611 - RNA, 25 nt, Artificial Sequence
  Description of Artificial Sequence: Synthetic oligonucleotide
ccugucucuuggauauucucgacac

SEQ ID NO: 6612 - RNA, 25 nt, Artificial Sequence
  Description of Artificial Sequence: Synthetic oligonucleotide
ugucucuuggauauucucgacacag

SEQ ID NO: 6613 - RNA, 25 nt, Artificial Sequence
  Description of Artificial Sequence: Synthetic oligonucleotide
gucucuuggauauucucgacacagc

SEQ ID NO: 6614 - RNA, 25 nt, Artificial Sequence
  Description of Artificial Sequence: Synthetic oligonucleotide
ucucuuggauauucucgacacagca

SEQ ID NO: 6615 - RNA, 25 nt, Artificial Sequence
  Description of Artificial Sequence: Synthetic oligonucleotide
cucuuggauauucucgacacagcag

SEQ ID NO: 6616 - RNA, 25 nt, Artificial Sequence
  Description of Artificial Sequence: Synthetic oligonucleotide
ucuuggauauucucgacacagcagg

SEQ ID NO: 6617 - RNA, 25 nt, Artificial Sequence
  Description of Artificial Sequence: Synthetic oligonucleotide
cuuggauauucucgacacagcaggu

SEQ ID NO: 6618 - RNA, 25 nt, Artificial Sequence
  Description of Artificial Sequence: Synthetic oligonucleotide
uuggauauucucgacacagcagguc

SEQ ID NO: 6619 - RNA, 25 nt, Artificial Sequence
  Description of Artificial Sequence: Synthetic oligonucleotide
cagcaggucaagaggaguacagugc

SEQ ID NO: 6620 - RNA, 25 nt, Artificial Sequence
  Description of Artificial Sequence: Synthetic oligonucleotide
agcaggucaagaggaguacagugca

SEQ ID NO: 6621 - RNA, 25 nt, Artificial Sequence
  Description of Artificial Sequence: Synthetic oligonucleotide
gcaggucaagaggaguacagugcaa

SEQ ID NO: 6622 - RNA, 25 nt, Artificial Sequence
  Description of Artificial Sequence: Synthetic oligonucleotide
aggaguacagugcaaugagggacca

SEQ ID NO: 6623 - RNA, 25 nt, Artificial Sequence
  Description of Artificial Sequence: Synthetic oligonucleotide
ggaguacagugcaaugagggaccag

SEQ ID NO: 6624 - RNA, 25 nt, Artificial Sequence
  Description of Artificial Sequence: Synthetic oligonucleotide
gaguacagugcaaugagggaccagu

SEQ ID NO: 6625 - RNA, 25 nt, Artificial Sequence
  Description of Artificial Sequence: Synthetic oligonucleotide
aguacagugcaaugagggaccagua

SEQ ID NO: 6626 - RNA, 25 nt, Artificial Sequence
  Description of Artificial Sequence: Synthetic oligonucleotide
guacagugcaaugagggaccaguac

SEQ ID NO: 6627 - RNA, 25 nt, Artificial Sequence
  Description of Artificial Sequence: Synthetic oligonucleotide
uacagugcaaugagggaccaguaca

SEQ ID NO: 6628 - RNA, 25 nt, Artificial Sequence
  Description of Artificial Sequence: Synthetic oligonucleotide
acagugcaaugagggaccaguacau

SEQ ID NO: 6629 - RNA, 25 nt, Artificial Sequence
  Description of Artificial Sequence: Synthetic oligonucleotide
cagugcaaugagggaccaguacaug

SEQ ID NO: 6630 - RNA, 25 nt, Artificial Sequence
  Description of Artificial Sequence: Synthetic oligonucleotide
agugcaaugagggaccaguacauga

SEQ ID NO: 6631 - RNA, 25 nt, Artificial Sequence
  Description of Artificial Sequence: Synthetic oligonucleotide
guauuugccauaaauaauacuaaau

SEQ ID NO: 6632 - RNA, 25 nt, Artificial Sequence
  Description of Artificial Sequence: Synthetic oligonucleotide
uauuugccauaaauaauacuaaauc

SEQ ID NO: 6633 - RNA, 25 nt, Artificial Sequence
  Description of Artificial Sequence: Synthetic oligonucleotide
auuugccauaaauaauacuaaauca

SEQ ID NO: 6634 - RNA, 25 nt, Artificial Sequence
  Description of Artificial Sequence: Synthetic oligonucleotide
uuugccauaaauaauacuaaaucau

SEQ ID NO: 6635 - RNA, 25 nt, Artificial Sequence
  Description of Artificial Sequence: Synthetic oligonucleotide
uugccauaaauaauacuaaaucauu

SEQ ID NO: 6636 - RNA, 25 nt, Artificial Sequence
  Description of Artificial Sequence: Synthetic oligonucleotide
ugccauaaauaauacuaaaucauuu

SEQ ID NO: 6637 - RNA, 25 nt, Artificial Sequence
  Description of Artificial Sequence: Synthetic oligonucleotide
gccauaaauaauacuaaaucauuug

SEQ ID NO: 6638 - RNA, 25 nt, Artificial Sequence
  Description of Artificial Sequence: Synthetic oligonucleotide
auacuaaaucauuugaagauauuca

SEQ ID NO: 6639 - RNA, 25 nt, Artificial Sequence
  Description of Artificial Sequence: Synthetic oligonucleotide
uacuaaaucauuugaagauauucac

SEQ ID NO: 6640 - RNA, 25 nt, Artificial Sequence
  Description of Artificial Sequence: Synthetic oligonucleotide
acuaaaucauuugaagauauucacc

SEQ ID NO: 6641 - RNA, 25 nt, Artificial Sequence
  Description of Artificial Sequence: Synthetic oligonucleotide
cuaaaucauuugaagauauucacca

SEQ ID NO: 6642 - RNA, 25 nt, Artificial Sequence
  Description of Artificial Sequence: Synthetic oligonucleotide
uaaaucauuugaagauauucaccau

SEQ ID NO: 6643 - RNA, 25 nt, Artificial Sequence
  Description of Artificial Sequence: Synthetic oligonucleotide
aaaucauuugaagauauucaccauu

SEQ ID NO: 6644 - RNA, 25 nt, Artificial Sequence
  Description of Artificial Sequence: Synthetic oligonucleotide
aaucauuugaagauauucaccauua

SEQ ID NO: 6645 - RNA, 25 nt, Artificial Sequence
  Description of Artificial Sequence: Synthetic oligonucleotide
aucauuugaagauauucaccauuau

SEQ ID NO: 6646 - RNA, 25 nt, Artificial Sequence
  Description of Artificial Sequence: Synthetic oligonucleotide
ucauuugaagauauucaccauuaua

SEQ ID NO: 6647 - RNA, 25 nt, Artificial Sequence
  Description of Artificial Sequence: Synthetic oligonucleotide
auauucaccauuauagagaacaaau

SEQ ID NO: 6648 - RNA, 25 nt, Artificial Sequence
  Description of Artificial Sequence: Synthetic oligonucleotide
uauucaccauuauagagaacaaauu

SEQ ID NO: 6649 - RNA, 25 nt, Artificial Sequence
  Description of Artificial Sequence: Synthetic oligonucleotide
auucaccauuauagagaacaaauua

SEQ ID NO: 6650 - RNA, 25 nt, Artificial Sequence
  Description of Artificial Sequence: Synthetic oligonucleotide
uucaccauuauagagaacaaauuaa

SEQ ID NO: 6651 - RNA, 25 nt, Artificial Sequence
  Description of Artificial Sequence: Synthetic oligonucleotide
ucaccauuauagagaacaaauuaaa

SEQ ID NO: 6652 - RNA, 25 nt, Artificial Sequence
  Description of Artificial Sequence: Synthetic oligonucleotide
caccauuauagagaacaaauuaaaa

SEQ ID NO: 6653 - RNA, 25 nt, Artificial Sequence
  Description of Artificial Sequence: Synthetic oligonucleotide
accauuauagagaacaaauuaaaag

SEQ ID NO: 6654 - RNA, 25 nt, Artificial Sequence
  Description of Artificial Sequence: Synthetic oligonucleotide
ccauuauagagaacaaauuaaaaga

SEQ ID NO: 6655 - RNA, 25 nt, Artificial Sequence
  Description of Artificial Sequence: Synthetic oligonucleotide
cauuauagagaacaaauuaaaagag

SEQ ID NO: 6656 - RNA, 25 nt, Artificial Sequence
  Description of Artificial Sequence: Synthetic oligonucleotide
cuaugguccuaguaggaaauaaaug

SEQ ID NO: 6657 - RNA, 25 nt, Artificial Sequence
  Description of Artificial Sequence: Synthetic oligonucleotide
ugugauuugccuucuagaacaguag

SEQ ID NO: 6658 - RNA, 25 nt, Artificial Sequence
  Description of Artificial Sequence: Synthetic oligonucleotide
gugauuugccuucuagaacaguaga

SEQ ID NO: 6659 - RNA, 25 nt, Artificial Sequence
  Description of Artificial Sequence: Synthetic oligonucleotide
gauuugccuucuagaacaguagaca

SEQ ID NO: 6660 - RNA, 25 nt, Artificial Sequence
  Description of Artificial Sequence: Synthetic oligonucleotide
guuauggaauuccuuuuauugaaac

SEQ ID NO: 6661 - RNA, 25 nt, Artificial Sequence
  Description of Artificial Sequence: Synthetic oligonucleotide
uuauggaauuccuuuuauugaaaca

SEQ ID NO: 6662 - RNA, 25 nt, Artificial Sequence
  Description of Artificial Sequence: Synthetic oligonucleotide
uauggaauuccuuuuauugaaacau

SEQ ID NO: 6663 - RNA, 25 nt, Artificial Sequence
  Description of Artificial Sequence: Synthetic oligonucleotide
gaugccuucuauacauuaguucgag

SEQ ID NO: 6664 - RNA, 25 nt, Artificial Sequence
  Description of Artificial Sequence: Synthetic oligonucleotide
augccuucuauacauuaguucgaga

SEQ ID NO: 6665 - RNA, 25 nt, Artificial Sequence
  Description of Artificial Sequence: Synthetic oligonucleotide
cgagaaauucgaaaacauaaagaaa

SEQ ID NO: 6666 - RNA, 25 nt, Artificial Sequence
  Description of Artificial Sequence: Synthetic oligonucleotide
gaaaacauaaagaaaagaugagcaa

SEQ ID NO: 6667 - RNA, 25 nt, Artificial Sequence
  Description of Artificial Sequence: Synthetic oligonucleotide
aaaacauaaagaaaagaugagcaaa

SEQ ID NO: 6668 - RNA, 25 nt, Artificial Sequence
  Description of Artificial Sequence: Synthetic oligonucleotide
aaacauaaagaaaagaugagcaaag

SEQ ID NO: 6669 - RNA, 25 nt, Artificial Sequence
  Description of Artificial Sequence: Synthetic oligonucleotide
aacauaaagaaaagaugagcaaaga

SEQ ID NO: 6670 - RNA, 25 nt, Artificial Sequence
  Description of Artificial Sequence: Synthetic oligonucleotide
acauaaagaaaagaugagcaaagau

SEQ ID NO: 6671 - RNA, 25 nt, Artificial Sequence
  Description of Artificial Sequence: Synthetic oligonucleotide
cauaaagaaaagaugagcaaagaug

SEQ ID NO: 6672 - RNA, 25 nt, Artificial Sequence
  Description of Artificial Sequence: Synthetic oligonucleotide
auaaagaaaagaugagcaaagaugg

SEQ ID NO: 6673 - RNA, 25 nt, Artificial Sequence
  Description of Artificial Sequence: Synthetic oligonucleotide
uaaagaaaagaugagcaaagauggu

SEQ ID NO: 6674 - RNA, 25 nt, Artificial Sequence
  Description of Artificial Sequence: Synthetic oligonucleotide
aaagaaaagaugagcaaagauggua

SEQ ID NO: 6675 - RNA, 25 nt, Artificial Sequence
  Description of Artificial Sequence: Synthetic oligonucleotide
aagugguaauuuuuguacauuacac

SEQ ID NO: 6676 - RNA, 25 nt, Artificial Sequence
  Description of Artificial Sequence: Synthetic oligonucleotide
agugguaauuuuuguacauuacacu

SEQ ID NO: 6677 - RNA, 25 nt, Artificial Sequence
  Description of Artificial Sequence: Synthetic oligonucleotide
uuguacauuacacuaaauuauuagc

SEQ ID NO: 6678 - RNA, 25 nt, Artificial Sequence
  Description of Artificial Sequence: Synthetic oligonucleotide
uguacauuacacuaaauuauuagca

SEQ ID NO: 6679 - RNA, 25 nt, Artificial Sequence
  Description of Artificial Sequence: Synthetic oligonucleotide
guacauuacacuaaauuauuagcau

SEQ ID NO: 6680 - RNA, 25 nt, Artificial Sequence
  Description of Artificial Sequence: Synthetic oligonucleotide
uacauuacacuaaauuauuagcauu

SEQ ID NO: 6681 - RNA, 25 nt, Artificial Sequence
  Description of Artificial Sequence: Synthetic oligonucleotide
acauuacacuaaauuauuagcauuu

SEQ ID NO: 6682 - RNA, 25 nt, Artificial Sequence
  Description of Artificial Sequence: Synthetic oligonucleotide
cauuacacuaaauuauuagcauuug

SEQ ID NO: 6683 - RNA, 25 nt, Artificial Sequence
  Description of Artificial Sequence: Synthetic oligonucleotide
auuacacuaaauuauuagcauuugu

SEQ ID NO: 6684 - RNA, 25 nt, Artificial Sequence
  Description of Artificial Sequence: Synthetic oligonucleotide
uuacacuaaauuauuagcauuuguu

SEQ ID NO: 6685 - RNA, 25 nt, Artificial Sequence
  Description of Artificial Sequence: Synthetic oligonucleotide
uacacuaaauuauuagcauuuguuu

SEQ ID NO: 6686 - RNA, 25 nt, Artificial Sequence
  Description of Artificial Sequence: Synthetic oligonucleotide
uauuagcauuuguuuuagcauuacc

SEQ ID NO: 6687 - RNA, 25 nt, Artificial Sequence
  Description of Artificial Sequence: Synthetic oligonucleotide
auuagcauuuguuuuagcauuaccu

SEQ ID NO: 6688 - RNA, 25 nt, Artificial Sequence
  Description of Artificial Sequence: Synthetic oligonucleotide
uuagcauuuguuuuagcauuaccua

SEQ ID NO: 6689 - RNA, 25 nt, Artificial Sequence
  Description of Artificial Sequence: Synthetic oligonucleotide
uagcauuuguuuuagcauuaccuaa

SEQ ID NO: 6690 - RNA, 25 nt, Artificial Sequence
  Description of Artificial Sequence: Synthetic oligonucleotide
agcauuuguuuuagcauuaccuaau

SEQ ID NO: 6691 - RNA, 25 nt, Artificial Sequence
  Description of Artificial Sequence: Synthetic oligonucleotide
gcauuuguuuuagcauuaccuaauu

SEQ ID NO: 6692 - RNA, 25 nt, Artificial Sequence
  Description of Artificial Sequence: Synthetic oligonucleotide
cauuuguuuuagcauuaccuaauuu

SEQ ID NO: 6693 - RNA, 25 nt, Artificial Sequence
  Description of Artificial Sequence: Synthetic oligonucleotide
auuuguuuuagcauuaccuaauuuu

SEQ ID NO: 6694 - RNA, 25 nt, Artificial Sequence
  Description of Artificial Sequence: Synthetic oligonucleotide
uuuguuuuagcauuaccuaauuuuu

SEQ ID NO: 6695 - RNA, 25 nt, Artificial Sequence
  Description of Artificial Sequence: Synthetic oligonucleotide
cuuauuuuaaaaugacaguggaagu

SEQ ID NO: 6696 - RNA, 25 nt, Artificial Sequence
  Description of Artificial Sequence: Synthetic oligonucleotide
uauuuuaaaaugacaguggaaguuu

SEQ ID NO: 6697 - RNA, 25 nt, Artificial Sequence
  Description of Artificial Sequence: Synthetic oligonucleotide
ucuaagugccaguauucccagaguu

SEQ ID NO: 6698 - RNA, 25 nt, Artificial Sequence
  Description of Artificial Sequence: Synthetic oligonucleotide
caaauuaaugaagcuuuugaaucau

SEQ ID NO: 6699 - RNA, 25 nt, Artificial Sequence
  Description of Artificial Sequence: Synthetic oligonucleotide
aaauuaaugaagcuuuugaaucauc

SEQ ID NO: 6700 - RNA, 25 nt, Artificial Sequence
  Description of Artificial Sequence: Synthetic oligonucleotide
uguguuuuaucuagucacauaaaug

SEQ ID NO: 6701 - RNA, 25 nt, Artificial Sequence
  Description of Artificial Sequence: Synthetic oligonucleotide
guguuuuaucuagucacauaaaugg

SEQ ID NO: 6702 - RNA, 25 nt, Artificial Sequence
  Description of Artificial Sequence: Synthetic oligonucleotide
uuuuaucuagucacauaaauggauu

SEQ ID NO: 6703 - RNA, 25 nt, Artificial Sequence
  Description of Artificial Sequence: Synthetic oligonucleotide
uaaauggauuaauuacuaauuucag

SEQ ID NO: 6704 - RNA, 25 nt, Artificial Sequence
  Description of Artificial Sequence: Synthetic oligonucleotide
aaauggauuaauuacuaauuucagu

SEQ ID NO: 6705 - RNA, 25 nt, Artificial Sequence
  Description of Artificial Sequence: Synthetic oligonucleotide
auugguuuuuacugaaacauugagg

SEQ ID NO: 6706 - RNA, 25 nt, Artificial Sequence
  Description of Artificial Sequence: Synthetic oligonucleotide
cauuuccuuuucacauuagauaaau

SEQ ID NO: 6707 - RNA, 25 nt, Artificial Sequence
  Description of Artificial Sequence: Synthetic oligonucleotide
cuuuucacauuagauaaauuacuau

SEQ ID NO: 6708 - RNA, 25 nt, Artificial Sequence
  Description of Artificial Sequence: Synthetic oligonucleotide
cauuagauaaauuacuauaaagacu

SEQ ID NO: 6709 - RNA, 25 nt, Artificial Sequence
  Description of Artificial Sequence: Synthetic oligonucleotide
auuagauaaauuacuauaaagacuc

SEQ ID NO: 6710 - RNA, 25 nt, Artificial Sequence
  Description of Artificial Sequence: Synthetic oligonucleotide
uuagauaaauuacuauaaagacucc

SEQ ID NO: 6711 - RNA, 25 nt, Artificial Sequence
  Description of Artificial Sequence: Synthetic oligonucleotide
uaaggcagacccaguaugaaauggg

SEQ ID NO: 6712 - RNA, 25 nt, Artificial Sequence
  Description of Artificial Sequence: Synthetic oligonucleotide
aaggcagacccaguaugaaaugggg

SEQ ID NO: 6713 - RNA, 25 nt, Artificial Sequence
  Description of Artificial Sequence: Synthetic oligonucleotide
aggcagacccaguaugaaaugggga

SEQ ID NO: 6714 - RNA, 25 nt, Artificial Sequence
  Description of Artificial Sequence: Synthetic oligonucleotide
ggcagacccaguaugaaauggggau

SEQ ID NO: 6715 - RNA, 25 nt, Artificial Sequence
  Description of Artificial Sequence: Synthetic oligonucleotide
uaugaaauggggauuauuauagcaa

SEQ ID NO: 6716 - RNA, 25 nt, Artificial Sequence
  Description of Artificial Sequence: Synthetic oligonucleotide
gggauuauuauagcaaccauuuugg

SEQ ID NO: 6717 - RNA, 25 nt, Artificial Sequence
  Description of Artificial Sequence: Synthetic oligonucleotide
gggcuauauuuacaugcuacuaaau

SEQ ID NO: 6718 - RNA, 25 nt, Artificial Sequence
  Description of Artificial Sequence: Synthetic oligonucleotide
ggcuauauuuacaugcuacuaaauu

SEQ ID NO: 6719 - RNA, 25 nt, Artificial Sequence
  Description of Artificial Sequence: Synthetic oligonucleotide
gcuauauuuacaugcuacuaaauuu

SEQ ID NO: 6720 - RNA, 25 nt, Artificial Sequence
  Description of Artificial Sequence: Synthetic oligonucleotide
cuauauuuacaugcuacuaaauuuu

SEQ ID NO: 6721 - RNA, 25 nt, Artificial Sequence
  Description of Artificial Sequence: Synthetic oligonucleotide
uauauuuacaugcuacuaaauuuuu

SEQ ID NO: 6722 - RNA, 25 nt, Artificial Sequence
  Description of Artificial Sequence: Synthetic oligonucleotide
auauuuacaugcuacuaaauuuuua

SEQ ID NO: 6723 - RNA, 25 nt, Artificial Sequence
  Description of Artificial Sequence: Synthetic oligonucleotide
uauuuacaugcuacuaaauuuuuau

SEQ ID NO: 6724 - RNA, 25 nt, Artificial Sequence
  Description of Artificial Sequence: Synthetic oligonucleotide
auuuacaugcuacuaaauuuuuaua

SEQ ID NO: 6725 - RNA, 25 nt, Artificial Sequence
  Description of Artificial Sequence: Synthetic oligonucleotide
uuuacaugcuacuaaauuuuuauaa

SEQ ID NO: 6726 - RNA, 25 nt, Artificial Sequence
  Description of Artificial Sequence: Synthetic oligonucleotide
uuacaugcuacuaaauuuuuauaau

SEQ ID NO: 6727 - RNA, 25 nt, Artificial Sequence
  Description of Artificial Sequence: Synthetic oligonucleotide
uacaugcuacuaaauuuuuauaaua

SEQ ID NO: 6728 - RNA, 25 nt, Artificial Sequence
  Description of Artificial Sequence: Synthetic oligonucleotide
cuuucauaguauaacuuuaaaucuu

SEQ ID NO: 6729 - RNA, 25 nt, Artificial Sequence
  Description of Artificial Sequence: Synthetic oligonucleotide
auaguauaacuuuaaaucuuuucuu

SEQ ID NO: 6730 - RNA, 25 nt, Artificial Sequence
  Description of Artificial Sequence: Synthetic oligonucleotide
uaguauaacuuuaaaucuuuucuuc

SEQ ID NO: 6731 - RNA, 25 nt, Artificial Sequence
  Description of Artificial Sequence: Synthetic oligonucleotide
uaaaucuuuucuucaacuugagucu

SEQ ID NO: 6732 - RNA, 25 nt, Artificial Sequence
  Description of Artificial Sequence: Synthetic oligonucleotide
aaaucuuuucuucaacuugagucuu

SEQ ID NO: 6733 - RNA, 25 nt, Artificial Sequence
  Description of Artificial Sequence: Synthetic oligonucleotide
cuugagucuuugaagauaguuuuaa

SEQ ID NO: 6734 - RNA, 25 nt, Artificial Sequence
  Description of Artificial Sequence: Synthetic oligonucleotide
ugagucuuugaagauaguuuuaauu

SEQ ID NO: 6735 - RNA, 25 nt, Artificial Sequence
  Description of Artificial Sequence: Synthetic oligonucleotide
gagucuuugaagauaguuuuaauuc

SEQ ID NO: 6736 - RNA, 25 nt, Artificial Sequence
  Description of Artificial Sequence: Synthetic oligonucleotide
gauaguuuuaauucugcuugugaca

SEQ ID NO: 6737 - RNA, 25 nt, Artificial Sequence
  Description of Artificial Sequence: Synthetic oligonucleotide
auaguuuuaauucugcuugugacau

SEQ ID NO: 6738 - RNA, 25 nt, Artificial Sequence
  Description of Artificial Sequence: Synthetic oligonucleotide
uaguuuuaauucugcuugugacauu

SEQ ID NO: 6739 - RNA, 25 nt, Artificial Sequence
  Description of Artificial Sequence: Synthetic oligonucleotide
cuugugacauuaaaagauuauuugg

SEQ ID NO: 6740 - RNA, 25 nt, Artificial Sequence
  Description of Artificial Sequence: Synthetic oligonucleotide
uauuaacucaaaaguugagauuuug

SEQ ID NO: 6741 - RNA, 25 nt, Artificial Sequence
  Description of Artificial Sequence: Synthetic oligonucleotide
ugugccaagacauuaauuuuuuuuu

SEQ ID NO: 6742 - RNA, 25 nt, Artificial Sequence
  Description of Artificial Sequence: Synthetic oligonucleotide
ugguuaaauuaacauugcauaaaca

SEQ ID NO: 6743 - RNA, 25 nt, Artificial Sequence
  Description of Artificial Sequence: Synthetic oligonucleotide
gguuaaauuaacauugcauaaacac

SEQ ID NO: 6744 - RNA, 25 nt, Artificial Sequence
  Description of Artificial Sequence: Synthetic oligonucleotide
guuaaauuaacauugcauaaacacu

SEQ ID NO: 6745 - RNA, 25 nt, Artificial Sequence
  Description of Artificial Sequence: Synthetic oligonucleotide
auugcauaaacacuuuucaagucug

SEQ ID NO: 6746 - RNA, 25 nt, Artificial Sequence
  Description of Artificial Sequence: Synthetic oligonucleotide
aagucugauccauauuuaauaaugc

SEQ ID NO: 6747 - RNA, 25 nt, Artificial Sequence
  Description of Artificial Sequence: Synthetic oligonucleotide
uaaaauaaaugaagugagauggcau

SEQ ID NO: 6748 - RNA, 25 nt, Artificial Sequence
  Description of Artificial Sequence: Synthetic oligonucleotide
aaaauaaaugaagugagauggcaug

SEQ ID NO: 6749 - RNA, 25 nt, Artificial Sequence
  Description of Artificial Sequence: Synthetic oligonucleotide
aagcucagcacaaucuguaaauuuu

SEQ ID NO: 6750 - RNA, 25 nt, Artificial Sequence
  Description of Artificial Sequence: Synthetic oligonucleotide
agcucagcacaaucuguaaauuuuu

SEQ ID NO: 6751 - RNA, 25 nt, Artificial Sequence
  Description of Artificial Sequence: Synthetic oligonucleotide
auaacugugauucuuuuaggacaau

SEQ ID NO: 6752 - RNA, 25 nt, Artificial Sequence
  Description of Artificial Sequence: Synthetic oligonucleotide
ugugauucuuuuaggacaauuacug

SEQ ID NO: 6753 - RNA, 25 nt, Artificial Sequence
  Description of Artificial Sequence: Synthetic oligonucleotide
gugauucuuuuaggacaauuacugu

SEQ ID NO: 6754 - RNA, 25 nt, Artificial Sequence
  Description of Artificial Sequence: Synthetic oligonucleotide
uguaugucagauauucauauugacc

SEQ ID NO: 6755 - RNA, 25 nt, Artificial Sequence
  Description of Artificial Sequence: Synthetic oligonucleotide
guaugucagauauucauauugaccc

SEQ ID NO: 6756 - RNA, 25 nt, Artificial Sequence
  Description of Artificial Sequence: Synthetic oligonucleotide
aauguguaauauuccaguuuucucu

SEQ ID NO: 6757 - RNA, 25 nt, Artificial Sequence
  Description of Artificial Sequence: Synthetic oligonucleotide
cacugcauaggaauuuagaaccuaa

SEQ ID NO: 6758 - RNA, 25 nt, Artificial Sequence
  Description of Artificial Sequence: Synthetic oligonucleotide
caccauugcacaauuuuguccuaau

SEQ ID NO: 6759 - RNA, 25 nt, Artificial Sequence
  Description of Artificial Sequence: Synthetic oligonucleotide
accauugcacaauuuuguccuaaua

SEQ ID NO: 6760 - RNA, 25 nt, Artificial Sequence
  Description of Artificial Sequence: Synthetic oligonucleotide
ccauugcacaauuuuguccuaauau

SEQ ID NO: 6761 - RNA, 25 nt, Artificial Sequence
  Description of Artificial Sequence: Synthetic oligonucleotide
cauugcacaauuuuguccuaauaua

SEQ ID NO: 6762 - RNA, 25 nt, Artificial Sequence
  Description of Artificial Sequence: Synthetic oligonucleotide
auugcacaauuuuguccuaauauau

SEQ ID NO: 6763 - RNA, 25 nt, Artificial Sequence
  Description of Artificial Sequence: Synthetic oligonucleotide
uugcacaauuuuguccuaauauaua

SEQ ID NO: 6764 - RNA, 25 nt, Artificial Sequence
  Description of Artificial Sequence: Synthetic oligonucleotide
uagcaugaauucugcauugagaaac

SEQ ID NO: 6765 - RNA, 25 nt, Artificial Sequence
  Description of Artificial Sequence: Synthetic oligonucleotide
agcaugaauucugcauugagaaacu

SEQ ID NO: 6766 - RNA, 25 nt, Artificial Sequence
  Description of Artificial Sequence: Synthetic oligonucleotide
uuugaagugccuguuugggauaaug

SEQ ID NO: 6767 - RNA, 25 nt, Artificial Sequence
  Description of Artificial Sequence: Synthetic oligonucleotide
uugaagugccuguuugggauaauga

SEQ ID NO: 6768 - RNA, 25 nt, Artificial Sequence
  Description of Artificial Sequence: Synthetic oligonucleotide
ugaagugccuguuugggauaaugau

SEQ ID NO: 6769 - RNA, 25 nt, Artificial Sequence
  Description of Artificial Sequence: Synthetic oligonucleotide
uuugagugccaauuucuuacuagua

SEQ ID NO: 6770 - RNA, 25 nt, Artificial Sequence
  Description of Artificial Sequence: Synthetic oligonucleotide
uugagugccaauuucuuacuaguac

SEQ ID NO: 6771 - RNA, 25 nt, Artificial Sequence
  Description of Artificial Sequence: Synthetic oligonucleotide
ugagugccaauuucuuacuaguacu

SEQ ID NO: 6772 - RNA, 25 nt, Artificial Sequence
  Description of Artificial Sequence: Synthetic oligonucleotide
gagugccaauuucuuacuaguacua

SEQ ID NO: 6773 - RNA, 25 nt, Artificial Sequence
  Description of Artificial Sequence: Synthetic oligonucleotide
agugccaauuucuuacuaguacuau

SEQ ID NO: 6774 - RNA, 25 nt, Artificial Sequence
  Description of Artificial Sequence: Synthetic oligonucleotide
gugccaauuucuuacuaguacuauu

SEQ ID NO: 6775 - RNA, 25 nt, Artificial Sequence
  Description of Artificial Sequence: Synthetic oligonucleotide
auguauuuuaacuauuuuuguauag

SEQ ID NO: 6776 - RNA, 25 nt, Artificial Sequence
  Description of Artificial Sequence: Synthetic oligonucleotide
uguauuuuaacuauuuuuguauagu

SEQ ID NO: 6777 - RNA, 25 nt, Artificial Sequence
  Description of Artificial Sequence: Synthetic oligonucleotide
acuauuuuuguauaguguaaacuga

SEQ ID NO: 6778 - RNA, 25 nt, Artificial Sequence
  Description of Artificial Sequence: Synthetic oligonucleotide
cuauuuuuguauaguguaaacugaa

SEQ ID NO: 6779 - RNA, 25 nt, Artificial Sequence
  Description of Artificial Sequence: Synthetic oligonucleotide
uauuuuuguauaguguaaacugaaa

SEQ ID NO: 6780 - RNA, 25 nt, Artificial Sequence
  Description of Artificial Sequence: Synthetic oligonucleotide
auuuuuguauaguguaaacugaaac

SEQ ID NO: 6781 - RNA, 25 nt, Artificial Sequence
  Description of Artificial Sequence: Synthetic oligonucleotide
uuuuuguauaguguaaacugaaaca

SEQ ID NO: 6782 - RNA, 25 nt, Artificial Sequence
  Description of Artificial Sequence: Synthetic oligonucleotide
uuuuguauaguguaaacugaaacau

SEQ ID NO: 6783 - RNA, 25 nt, Artificial Sequence
  Description of Artificial Sequence: Synthetic oligonucleotide
aacaugcacauuuuguacauugugc

SEQ ID NO: 6784 - RNA, 25 nt, Artificial Sequence
  Description of Artificial Sequence: Synthetic oligonucleotide
acaugcacauuuuguacauugugcu

SEQ ID NO: 6785 - RNA, 25 nt, Artificial Sequence
  Description of Artificial Sequence: Synthetic oligonucleotide
ugcacauuuuguacauugugcuuuc

SEQ ID NO: 6786 - RNA, 25 nt, Artificial Sequence
  Description of Artificial Sequence: Synthetic oligonucleotide
gcacauuuuguacauugugcuuucu

SEQ ID NO: 6787 - RNA, 25 nt, Artificial Sequence
  Description of Artificial Sequence: Synthetic oligonucleotide
cacauuuuguacauugugcuuucuu

SEQ ID NO: 6788 - RNA, 25 nt, Artificial Sequence
  Description of Artificial Sequence: Synthetic oligonucleotide
acauuuuguacauugugcuuucuuu

SEQ ID NO: 6789 - RNA, 25 nt, Artificial Sequence
  Description of Artificial Sequence: Synthetic oligonucleotide
cauuuuguacauugugcuuucuuuu

SEQ ID NO: 6790 - RNA, 25 nt, Artificial Sequence
  Description of Artificial Sequence: Synthetic oligonucleotide
auuuuguacauugugcuuucuuuug

SEQ ID NO: 6791 - RNA, 25 nt, Artificial Sequence
  Description of Artificial Sequence: Synthetic oligonucleotide
uuuuguacauugugcuuucuuuugu

SEQ ID NO: 6792 - RNA, 25 nt, Artificial Sequence
  Description of Artificial Sequence: Synthetic oligonucleotide
ugggacauaugcagugugauccagu

SEQ ID NO: 6793 - RNA, 25 nt, Artificial Sequence
  Description of Artificial Sequence: Synthetic oligonucleotide
gggacauaugcagugugauccaguu

SEQ ID NO: 6794 - RNA, 25 nt, Artificial Sequence
  Description of Artificial Sequence: Synthetic oligonucleotide
ggacauaugcagugugauccaguug

SEQ ID NO: 6795 - RNA, 25 nt, Artificial Sequence
  Description of Artificial Sequence: Synthetic oligonucleotide
gacauaugcagugugauccaguugu

SEQ ID NO: 6796 - RNA, 25 nt, Artificial Sequence
  Description of Artificial Sequence: Synthetic oligonucleotide
acauaugcagugugauccaguuguu

SEQ ID NO: 6797 - RNA, 25 nt, Artificial Sequence
  Description of Artificial Sequence: Synthetic oligonucleotide
cauaugcagugugauccaguuguuu

SEQ ID NO: 6798 - RNA, 25 nt, Artificial Sequence
  Description of Artificial Sequence: Synthetic oligonucleotide
auaugcagugugauccaguuguuuu

SEQ ID NO: 6799 - RNA, 25 nt, Artificial Sequence
  Description of Artificial Sequence: Synthetic oligonucleotide
uaugcagugugauccaguuguuuuc

SEQ ID NO: 6800 - RNA, 25 nt, Artificial Sequence
  Description of Artificial Sequence: Synthetic oligonucleotide
augcagugugauccaguuguuuucc

SEQ ID NO: 6801 - RNA, 25 nt, Artificial Sequence
  Description of Artificial Sequence: Synthetic oligonucleotide
agugugauccaguuguuuuccauca

SEQ ID NO: 6802 - RNA, 25 nt, Artificial Sequence
  Description of Artificial Sequence: Synthetic oligonucleotide
gugugauccaguuguuuuccaucau

SEQ ID NO: 6803 - RNA, 25 nt, Artificial Sequence
  Description of Artificial Sequence: Synthetic oligonucleotide
ugugauccaguuguuuuccaucauu

SEQ ID NO: 6804 - RNA, 25 nt, Artificial Sequence
  Description of Artificial Sequence: Synthetic oligonucleotide
gugauccaguuguuuuccaucauuu

SEQ ID NO: 6805 - RNA, 25 nt, Artificial Sequence
  Description of Artificial Sequence: Synthetic oligonucleotide
ugauccaguuguuuuccaucauuug

SEQ ID NO: 6806 - RNA, 25 nt, Artificial Sequence
  Description of Artificial Sequence: Synthetic oligonucleotide
gauccaguuguuuuccaucauuugg

SEQ ID NO: 6807 - RNA, 25 nt, Artificial Sequence
  Description of Artificial Sequence: Synthetic oligonucleotide
uuugguugcgcugaccuaggaaugu

SEQ ID NO: 6808 - RNA, 25 nt, Artificial Sequence
  Description of Artificial Sequence: Synthetic oligonucleotide
uugguugcgcugaccuaggaauguu

SEQ ID NO: 6809 - RNA, 25 nt, Artificial Sequence
  Description of Artificial Sequence: Synthetic oligonucleotide
ggaauguuggucauaucaaacauua

SEQ ID NO: 6810 - RNA, 25 nt, Artificial Sequence
  Description of Artificial Sequence: Synthetic oligonucleotide
gaauguuggucauaucaaacauuaa

SEQ ID NO: 6811 - RNA, 25 nt, Artificial Sequence
  Description of Artificial Sequence: Synthetic oligonucleotide
aauguuggucauaucaaacauuaaa

SEQ ID NO: 6812 - RNA, 25 nt, Artificial Sequence
  Description of Artificial Sequence: Synthetic oligonucleotide
auguuggucauaucaaacauuaaaa

SEQ ID NO: 6813 - RNA, 25 nt, Artificial Sequence
  Description of Artificial Sequence: Synthetic oligonucleotide
uguuggucauaucaaacauuaaaaa

SEQ ID NO: 6814 - RNA, 25 nt, Artificial Sequence
  Description of Artificial Sequence: Synthetic oligonucleotide
guuggucauaucaaacauuaaaaau

SEQ ID NO: 6815 - RNA, 25 nt, Artificial Sequence
  Description of Artificial Sequence: Synthetic oligonucleotide
uuggucauaucaaacauuaaaaaug

SEQ ID NO: 6816 - RNA, 25 nt, Artificial Sequence
  Description of Artificial Sequence: Synthetic oligonucleotide
uggucauaucaaacauuaaaaauga

SEQ ID NO: 6817 - RNA, 25 nt, Artificial Sequence
  Description of Artificial Sequence: Synthetic oligonucleotide
ggucauaucaaacauuaaaaaugac

SEQ ID NO: 6818 - RNA, 25 nt, Artificial Sequence
  Description of Artificial Sequence: Synthetic oligonucleotide
aaauuaacuuuuaaauguuuauagg

SEQ ID NO: 6819 - RNA, 25 nt, Artificial Sequence
  Description of Artificial Sequence: Synthetic oligonucleotide
aauuaacuuuuaaauguuuauagga

SEQ ID NO: 6820 - RNA, 25 nt, Artificial Sequence
  Description of Artificial Sequence: Synthetic oligonucleotide
aacuuuuaaauguuuauaggaguau

SEQ ID NO: 6821 - RNA, 25 nt, Artificial Sequence
  Description of Artificial Sequence: Synthetic oligonucleotide
acuuuuaaauguuuauaggaguaug

SEQ ID NO: 6822 - RNA, 25 nt, Artificial Sequence
  Description of Artificial Sequence: Synthetic oligonucleotide
cuuuuaaauguuuauaggaguaugu

SEQ ID NO: 6823 - RNA, 25 nt, Artificial Sequence
  Description of Artificial Sequence: Synthetic oligonucleotide
uuuuaaauguuuauaggaguaugug

SEQ ID NO: 6824 - RNA, 25 nt, Artificial Sequence
  Description of Artificial Sequence: Synthetic oligonucleotide
uuuaaauguuuauaggaguaugugc

SEQ ID NO: 6825 - RNA, 25 nt, Artificial Sequence
  Description of Artificial Sequence: Synthetic oligonucleotide
uuaaauguuuauaggaguaugugcu

SEQ ID NO: 6826 - RNA, 25 nt, Artificial Sequence
  Description of Artificial Sequence: Synthetic oligonucleotide
aaauuuguaauauuuuugucaugaa

SEQ ID NO: 6827 - RNA, 25 nt, Artificial Sequence
  Description of Artificial Sequence: Synthetic oligonucleotide
aauuuguaauauuuuugucaugaac

SEQ ID NO: 6828 - RNA, 25 nt, Artificial Sequence
  Description of Artificial Sequence: Synthetic oligonucleotide
auuuguaauauuuuugucaugaacu

SEQ ID NO: 6829 - RNA, 25 nt, Artificial Sequence
  Description of Artificial Sequence: Synthetic oligonucleotide
uuuguaauauuuuugucaugaacug

SEQ ID NO: 6830 - RNA, 25 nt, Artificial Sequence
  Description of Artificial Sequence: Synthetic oligonucleotide
uuguaauauuuuugucaugaacugu

SEQ ID NO: 6831 - RNA, 25 nt, Artificial Sequence
  Description of Artificial Sequence: Synthetic oligonucleotide
uguaauauuuuugucaugaacugua

SEQ ID NO: 6832 - RNA, 25 nt, Artificial Sequence
  Description of Artificial Sequence: Synthetic oligonucleotide
guaauauuuuugucaugaacuguac

SEQ ID NO: 6833 - RNA, 25 nt, Artificial Sequence
  Description of Artificial Sequence: Synthetic oligonucleotide
uaauauuuuugucaugaacuguacu

SEQ ID NO: 6834 - RNA, 25 nt, Artificial Sequence
  Description of Artificial Sequence: Synthetic oligonucleotide
auuguaauguaauaaaaauaguuac

SEQ ID NO: 6835 - RNA, 25 nt, Artificial Sequence
  Description of Artificial Sequence: Synthetic oligonucleotide
uuguaauguaauaaaaauaguuaca

SEQ ID NO: 6836 - RNA, 25 nt, Artificial Sequence
  Description of Artificial Sequence: Synthetic oligonucleotide
uguaauguaauaaaaauaguuacag

SEQ ID NO: 6837 - RNA, 25 nt, Artificial Sequence
  Description of Artificial Sequence: Synthetic oligonucleotide
guaauguaauaaaaauaguuacagu

SEQ ID NO: 6838 - RNA, 25 nt, Artificial Sequence
  Description of Artificial Sequence: Synthetic oligonucleotide
uaauguaauaaaaauaguuacagug

SEQ ID NO: 6839 - RNA, 104 nt, Artificial Sequence
  Description of Artificial Sequence: Synthetic oligonucleotide
  misc_feature (22)..(104): n is a, c, g, or u
  See specification as filed for detailed description of substitutions and preferred embodiments
guauuugccauaaauaauacunnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6840 - RNA, 106 nt, Artificial Sequence
  Description of Artificial Sequence: Synthetic oligonucleotide
  misc_feature (1)..(85): n is a, c, g, or u
  See specification as filed for detailed description of substitutions and preferred embodiments
nnnnnnnnnnnnnnnnnnnnnnnnnnnnnnnnnnnnnnnnnnnnnnnnnnnnnnnnnnnnnnnnnnnnnnnnnnnnnnnnnnnnnuauuauuuauggcaaauacac

SEQ ID NO: 6841 - DNA, 27 bp, Artificial Sequence
  Description of Artificial Sequence: Synthetic oligonucleotide
  misc_feature (22)..(27): n is a, c, g, or t
gtgtatttgccataaataatannnnnn

SEQ ID NO: 6842 - DNA, 34 bp, Artificial Sequence
  Description of Artificial Sequence: Synthetic oligonucleotide
tctttgtgtatttgccataaataatactaaatca

SEQ ID NO: 6843 - DNA, 21 bp, Homo sapiens
tagttggagctggtggcgtag

SEQ ID NO: 6844 - DNA, 21 bp, Homo sapiens
tagttggagctgttggcgtag

SEQ ID NO: 6845 - DNA, 21 bp, Homo sapiens
gatattctcgacacagcaggt

SEQ ID NO: 6846 - DNA, 21 bp, Homo sapiens
gatattctcgacacagcaggt

SEQ ID NO: 6847 - DNA, 21 bp, Homo sapiens
tattctcgacacagcaggtca

SEQ ID NO: 6848 - DNA, 21 bp, Homo sapiens
tattctcgacacagcaggtca

SEQ ID NO: 6849 - DNA, 21 bp, Homo sapiens
agcaggtcaagaggagtacag

SEQ ID NO: 6850 - DNA, 21 bp, Homo sapiens
agcaggtcatgaggagtacag

SEQ ID NO: 6851 - DNA, 21 bp, Homo sapiens
tcaagaggagtacagtgcaat

SEQ ID NO: 6852 - DNA, 21 bp, Homo sapiens
tcatgaggagtacagtgcaat

SEQ ID NO: 6853 - DNA, 21 bp, Homo sapiens
tacagtgcaatgagggaccag

SEQ ID NO: 6854 - DNA, 21 bp, Homo sapiens
actggggagggctttctttgt

SEQ ID NO: 6855 - DNA, 21 bp, Homo sapiens
ggggagggctttctttgtgta

SEQ ID NO: 6856 - DNA, 21 bp, Homo sapiens
ggagggctttctttgtgtatt

SEQ ID NO: 6857 - DNA, 21 bp, Homo sapiens
ggctttctttgtgtatttgcc

SEQ ID NO: 6858 - DNA, 21 bp, Homo sapiens
tctttgtgtatttgccataaa

SEQ ID NO: 6859 - DNA, 21 bp, Homo sapiens
ctttgtgtatttgccataaat

SEQ ID NO: 6860 - DNA, 21 bp, Homo sapiens
tttgtgtatttgccataaata

SEQ ID NO: 6861 - DNA, 21 bp, Homo sapiens
ttgtgtatttgccataaataa

SEQ ID NO: 6862 - DNA, 21 bp, Homo sapiens
tgtgtatttgccataaataat

SEQ ID NO: 6863 - DNA, 21 bp, Homo sapiens
gtgtatttgccataaataata

SEQ ID NO: 6864 - DNA, 21 bp, Homo sapiens
ccataaataatactaaatcat

SEQ ID NO: 6865 - DNA, 21 bp, Homo sapiens
aataatactaaatcatttgaa

SEQ ID NO: 6866 - DNA, 21 bp, Homo sapiens
atactaaatcatttgaagata

SEQ ID NO: 6867 - DNA, 21 bp, Homo sapiens
actaaatcatttgaagatatt

SEQ ID NO: 6868 - DNA, 21 bp, Homo sapiens
atcatttgaagatattcacca

SEQ ID NO: 6869 - DNA, 21 bp, Homo sapiens
ttgaagatattcaccattata

SEQ ID NO: 6870 - DNA, 21 bp, Homo sapiens
gaagatattcaccattataga

SEQ ID NO: 6871 - DNA, 21 bp, Homo sapiens
acctatggtcctagtaggaaa

SEQ ID NO: 6872 - DNA, 21 bp, Homo sapiens
gtgatttgccttctagaacag

SEQ ID NO: 6873 - DNA, 21 bp, Homo sapiens
ttgatgatgccttctatacat

SEQ ID NO: 6874 - DNA, 21 bp, Homo sapiens
tacattagttcgagaaattcg

SEQ ID NO: 6875 - DNA, 21 bp, Homo sapiens
cgagaaattcgaaaacataaa

SEQ ID NO: 6876 - DNA, 21 bp, Homo sapiens
cgaaaacataaagaaaagatg

SEQ ID NO: 6877 - DNA, 21 bp, Homo sapiens
acataaagaaaagatgagcaa

SEQ ID NO: 6878 - DNA, 21 bp, Homo sapiens
acataaagaaaagatgagcaa

SEQ ID NO: 6879 - DNA, 21 bp, Homo sapiens
ttttgtacattacactaaatt

SEQ ID NO: 6880 - DNA, 21 bp, Homo sapiens
taaattattagcatttgtttt

SEQ ID NO: 6881 - DNA, 21 bp, Homo sapiens
tattagcatttgttttagcat

SEQ ID NO: 6882 - DNA, 21 bp, Homo sapiens
gaagtttttttttcctctaag

SEQ ID NO: 6883 - DNA, 21 bp, Homo sapiens
ctaagtgccagtattcccaga

SEQ ID NO: 6884 - DNA, 21 bp, Homo sapiens
ttggtgtgaaacaaattaatg

SEQ ID NO: 6885 - DNA, 21 bp, Homo sapiens
ggattaattactaatttcagt

SEQ ID NO: 6886 - DNA, 21 bp, Homo sapiens
gctatatttacatgctactaa

SEQ ID NO: 6887 - DNA, 21 bp, Homo sapiens
attttaactatttttgtatag

SEQ ID NO: 6888 - DNA, 21 bp, Homo sapiens
tgcagtgtgatccagttgttt

SEQ ID NO: 6889 - DNA, 21 bp, Homo sapiens
tgctgaaaatgactgaatata

SEQ ID NO: 6890 - DNA, 21 bp, Homo sapiens
aaatgactgaatataaacttg

SEQ ID NO: 6891 - DNA, 21 bp, Homo sapiens
gactgaatataaacttgtggt

SEQ ID NO: 6892 - DNA, 21 bp, Homo sapiens
agctaattcagaatcattttg

SEQ ID NO: 6893 - DNA, 21 bp, Homo sapiens
acgaatatgatccaacaatag

SEQ ID NO: 6894 - DNA, 21 bp, Homo sapiens
agcaagtagtaattgatggag

SEQ ID NO: 6895 - DNA, 21 bp, Homo sapiens
ggagggctttctttgtgtatt

SEQ ID NO: 6896 - DNA, 21 bp, Homo sapiens
tctttgtgtatttgccataaa

SEQ ID NO: 6897 - DNA, 21 bp, Homo sapiens
ctttgtgtatttgccataaat

SEQ ID NO: 6898 - DNA, 21 bp, Homo sapiens
tttgtgtatttgccataaata

SEQ ID NO: 6899 - DNA, 21 bp, Homo sapiens
ttgtgtatttgccataaataa

SEQ ID NO: 6900 - DNA, 21 bp, Homo sapiens
gtatttgccataaataatact

SEQ ID NO: 6901 - DNA, 21 bp, Homo sapiens
tatttgccataaataatacta

SEQ ID NO: 6902 - DNA, 21 bp, Homo sapiens
ccataaataatactaaatcat

SEQ ID NO: 6903 - DNA, 21 bp, Homo sapiens
cataaataatactaaatcatt

SEQ ID NO: 6904 - DNA, 21 bp, Homo sapiens
taaataatactaaatcatttg

SEQ ID NO: 6905 - DNA, 21 bp, Homo sapiens
aaataatactaaatcatttga

SEQ ID NO: 6906 - DNA, 21 bp, Homo sapiens
aataatactaaatcatttgaa

SEQ ID NO: 6907 - DNA, 21 bp, Homo sapiens
ataatactaaatcatttgaag

SEQ ID NO: 6908 - DNA, 21 bp, Homo sapiens
atttgaagatattcaccatta

SEQ ID NO: 6909 - DNA, 21 bp, Homo sapiens
ttgaagatattcaccattata

SEQ ID NO: 6910 - DNA, 21 bp, Homo sapiens
tgaagatattcaccattatag

SEQ ID NO: 6911 - DNA, 21 bp, Homo sapiens
gaagatattcaccattataga

SEQ ID NO: 6912 - DNA, 21 bp, Homo sapiens
aagatattcaccattatagag

SEQ ID NO: 6913 - DNA, 21 bp, Homo sapiens
ccattatagagaacaaattaa

SEQ ID NO: 6914 - DNA, 21 bp, Homo sapiens
attatagagaacaaattaaaa

SEQ ID NO: 6915 - DNA, 21 bp, Homo sapiens
ttatagagaacaaattaaaag

SEQ ID NO: 6916 - DNA, 21 bp, Homo sapiens
tatagagaacaaattaaaaga

SEQ ID NO: 6917 - DNA, 21 bp, Homo sapiens
atagagaacaaattaaaagag

SEQ ID NO: 6918 - DNA, 21 bp, Homo sapiens
ctagtaggaaataaatgtgat

SEQ ID NO: 6919 - DNA, 21 bp, Homo sapiens
tagtaggaaataaatgtgatt

SEQ ID NO: 6920 - DNA, 21 bp, Homo sapiens
aagaagttatggaattccttt

SEQ ID NO: 6921 - DNA, 21 bp, Homo sapiens
aagttatggaattccttttat

SEQ ID NO: 6922 - DNA, 21 bp, Homo sapiens
agttatggaattccttttatt

SEQ ID NO: 6923 - DNA, 21 bp, Homo sapiens
gttatggaattccttttattg

SEQ ID NO: 6924 - DNA, 21 bp, Homo sapiens
ttatggaattccttttattga

SEQ ID NO: 6925 - DNA, 21 bp, Homo sapiens
tggaggatgctttttatacat

SEQ ID NO: 6926 - DNA, 21 bp, Homo sapiens
gaggatgctttttatacattg

SEQ ID NO: 6927 - DNA, 21 bp, Homo sapiens
acagattgaaaaaaatcagca

SEQ ID NO: 6928 - DNA, 21 bp, Homo sapiens
cagattgaaaaaaatcagcaa

SEQ ID NO: 6929 - DNA, 21 bp, Homo sapiens
gattgaaaaaaatcagcaaag

SEQ ID NO: 6930 - DNA, 21 bp, Homo sapiens
attgaaaaaaatcagcaaaga

SEQ ID NO: 6931 - DNA, 21 bp, Homo sapiens
ttgaaaaaaatcagcaaagaa

SEQ ID NO: 6932 - DNA, 21 bp, Homo sapiens
tgaaaaaaatcagcaaagaag

SEQ ID NO: 6933 - DNA, 21 bp, Homo sapiens
tcctggctgtgtgaaaattaa

SEQ ID NO: 6934 - DNA, 21 bp, Homo sapiens
ggctgtgtgaaaattaaaaaa

SEQ ID NO: 6935 - DNA, 21 bp, Homo sapiens
gtgtgaaaattaaaaaatgca

SEQ ID NO: 6936 - DNA, 21 bp, Homo sapiens
tgtgaaaattaaaaaatgcat

SEQ ID NO: 6937 - DNA, 21 bp, Homo sapiens
gtgaaaattaaaaaatgcatt

SEQ ID NO: 6938 - DNA, 21 bp, Homo sapiens
tgaaaattaaaaaatgcatta

SEQ ID NO: 6939 - DNA, 21 bp, Homo sapiens
aaaattaaaaaatgcattata

SEQ ID NO: 6940 - DNA, 21 bp, Homo sapiens
aaattaaaaaatgcattataa

SEQ ID NO: 6941 - DNA, 21 bp, Homo sapiens
aattaaaaaatgcattataat

SEQ ID NO: 6942 - DNA, 21 bp, Homo sapiens
attaaaaaatgcattataatg

SEQ ID NO: 6943 - DNA, 21 bp, Homo sapiens
taaaaaatgcattataatgta

SEQ ID NO: 6944 - DNA, 21 bp, Homo sapiens
tgcattataatgtaatctggg

SEQ ID NO: 6945 - DNA, 21 bp, Homo sapiens
ttcgagaaattcgaaaacata

SEQ ID NO: 6946 - DNA, 21 bp, Homo sapiens
tcgagaaattcgaaaacataa

SEQ ID NO: 6947 - DNA, 21 bp, Homo sapiens
cgagaaattcgaaaacataaa

SEQ ID NO: 6948 - DNA, 21 bp, Homo sapiens
gaaattcgaaaacataaagaa

SEQ ID NO: 6949 - DNA, 21 bp, Homo sapiens
tcgaaaacataaagaaaagat

SEQ ID NO: 6950 - DNA, 21 bp, Homo sapiens
cgaaaacataaagaaaagatg

SEQ ID NO: 6951 - DNA, 21 bp, Homo sapiens
aaagatggtaaaaagaagaaa

SEQ ID NO: 6952 - DNA, 21 bp, Homo sapiens
aagatggtaaaaagaagaaaa

SEQ ID NO: 6953 - DNA, 21 bp, Homo sapiens
gatggtaaaaagaagaaaaag

SEQ ID NO: 6954 - DNA, 21 bp, Homo sapiens
atggtaaaaagaagaaaaaga

SEQ ID NO: 6955 - DNA, 21 bp, Homo sapiens
aaaaagaagaaaaagaagtca

SEQ ID NO: 6956 - DNA, 21 bp, Homo sapiens
aaaagaagaaaaagaagtcaa

SEQ ID NO: 6957 - DNA, 21 bp, Homo sapiens
aaagaagaaaaagaagtcaaa

SEQ ID NO: 6958 - DNA, 21 bp, Homo sapiens
tcaaagacaaagtgtgtaatt

SEQ ID NO: 6959 - DNA, 21 bp, Homo sapiens
caaagacaaagtgtgtaatta

SEQ ID NO: 6960 - DNA, 21 bp, Homo sapiens
gacaaagtgtgtaattatgta

SEQ ID NO: 6961 - DNA, 21 bp, Homo sapiens
caaagtgtgtaattatgtaaa

SEQ ID NO: 6962 - DNA, 21 bp, Homo sapiens
gtgtgtaattatgtaaataca

SEQ ID NO: 6963 - DNA, 21 bp, Homo sapiens
gtgtaattatgtaaatacaat

SEQ ID NO: 6964 - DNA, 21 bp, Homo sapiens
gtaattatgtaaatacaattt

SEQ ID NO: 6965 - DNA, 21 bp, Homo sapiens
taattatgtaaatacaatttg

SEQ ID NO: 6966 - DNA, 21 bp, Homo sapiens
tatgtaaatacaatttgtact

SEQ ID NO: 6967 - DNA, 21 bp, Homo sapiens
atgtaaatacaatttgtactt

SEQ ID NO: 6968 - DNA, 21 bp, Homo sapiens
tgtaaatacaatttgtacttt

SEQ ID NO: 6969 - DNA, 21 bp, Homo sapiens
gtaaatacaatttgtactttt

SEQ ID NO: 6970 - DNA, 21 bp, Homo sapiens
acaatttgtacttttttctta

SEQ ID NO: 6971 - DNA, 21 bp, Homo sapiens
caatttgtacttttttcttaa

SEQ ID NO: 6972 - DNA, 21 bp, Homo sapiens
tactagtacaagtggtaattt

SEQ ID NO: 6973 - DNA, 21 bp, Homo sapiens
actagtacaagtggtaatttt

SEQ ID NO: 6974 - DNA, 21 bp, Homo sapiens
acaagtggtaatttttgtaca

SEQ ID NO: 6975 - DNA, 21 bp, Homo sapiens
caagtggtaatttttgtacat

SEQ ID NO: 6976 - DNA, 21 bp, Homo sapiens
taatttttgtacattacacta

SEQ ID NO: 6977 - DNA, 21 bp, Homo sapiens
aatttttgtacattacactaa

SEQ ID NO: 6978 - DNA, 21 bp, Homo sapiens
atttttgtacattacactaaa

SEQ ID NO: 6979 - DNA, 21 bp, Homo sapiens
tttttgtacattacactaaat

SEQ ID NO: 6980 - DNA, 21 bp, Homo sapiens
ttttgtacattacactaaatt

SEQ ID NO: 6981 - DNA, 21 bp, Homo sapiens
cactaaattattagcatttgt

SEQ ID NO: 6982 - DNA, 21 bp, Homo sapiens
ctaaattattagcatttgttt

SEQ ID NO: 6983 - DNA, 21 bp, Homo sapiens
taaattattagcatttgtttt

SEQ ID NO: 6984 - DNA, 21 bp, Homo sapiens
tattagcatttgttttagcat

SEQ ID NO: 6985 - DNA, 21 bp, Homo sapiens
catttgttttagcattaccta

SEQ ID NO: 6986 - DNA, 21 bp, Homo sapiens
atttgttttagcattacctaa

SEQ ID NO: 6987 - DNA, 21 bp, Homo sapiens
ttgttttagcattacctaatt

SEQ ID NO: 6988 - DNA, 21 bp, Homo sapiens
tgttttagcattacctaattt

SEQ ID NO: 6989 - DNA, 21 bp, Homo sapiens
gttttagcattacctaatttt

SEQ ID NO: 6990 - DNA, 21 bp, Homo sapiens
ttttagcattacctaattttt

SEQ ID NO: 6991 - DNA, 21 bp, Homo sapiens
gactgttagcttttaccttaa

SEQ ID NO: 6992 - DNA, 21 bp, Homo sapiens
actgttagcttttaccttaaa

SEQ ID NO: 6993 - DNA, 21 bp, Homo sapiens
agcttttaccttaaatgctta

SEQ ID NO: 6994 - DNA, 21 bp, Homo sapiens
gcttttaccttaaatgcttat

SEQ ID NO: 6995 - DNA, 21 bp, Homo sapiens
cttttaccttaaatgcttatt

SEQ ID NO: 6996 - DNA, 21 bp, Homo sapiens
ccttaaatgcttattttaaaa

SEQ ID NO: 6997 - DNA, 21 bp, Homo sapiens
cttaaatgcttattttaaaat

SEQ ID NO: 6998 - DNA, 21 bp, Homo sapiens
tgcttattttaaaatgacagt

SEQ ID NO: 6999 - DNA, 21 bp, Homo sapiens
cttattttaaaatgacagtgg

SEQ ID NO: 7000 - DNA, 21 bp, Homo sapiens
gtggaagtttttttttcctct

SEQ ID NO: 7001 - DNA, 21 bp, Homo sapiens
ggaagtttttttttcctctaa

SEQ ID NO: 7002 - DNA, 21 bp, Homo sapiens
gaagtttttttttcctctaag

SEQ ID NO: 7003 - DNA, 21 bp, Homo sapiens
ttttggtttttgaactagcaa

SEQ ID NO: 7004 - DNA, 21 bp, Homo sapiens
gcctgtgaaaaagaaactgaa

SEQ ID NO: 7005 - DNA, 21 bp, Homo sapiens
aaaaagaaactgaatacctaa

SEQ ID NO: 7006 - DNA, 21 bp, Homo sapiens
aaaagaaactgaatacctaag

SEQ ID NO: 7007 - DNA, 21 bp, Homo sapiens
aactgaatacctaagatttct

SEQ ID NO: 7008 - DNA, 21 bp, Homo sapiens
tgcagttgattacttcttatt

SEQ ID NO: 7009 - DNA, 21 bp, Homo sapiens
gcagttgattacttcttattt

SEQ ID NO: 7010 - DNA, 21 bp, Homo sapiens
ttgattacttcttatttttct

SEQ ID NO: 7011 - DNA, 21 bp, Homo sapiens
ttcttatttttcttaccaatt

SEQ ID NO: 7012 - DNA, 21 bp, Homo sapiens
tcttatttttcttaccaattg

SEQ ID NO: 7013 - DNA, 21 bp, Homo sapiens
cttatttttcttaccaattgt

SEQ ID NO: 7014 - DNA, 21 bp, Homo sapiens
atgttggtgtgaaacaaatta

SEQ ID NO: 7015 - DNA, 21 bp, Homo sapiens
ttggtgtgaaacaaattaatg

SEQ ID NO: 7016 - DNA, 21 bp, Homo sapiens
tggtgtgaaacaaattaatga

SEQ ID NO: 7017 - DNA, 21 bp, Homo sapiens
aacaaattaatgaagcttttg

SEQ ID NO: 7018 - DNA, 21 bp, Homo sapiens
acaaattaatgaagcttttga

SEQ ID NO: 7019 - DNA, 21 bp, Homo sapiens
tctgtgttttatctagtcaca

SEQ ID NO: 7020 - DNA, 21 bp, Homo sapiens
ctgtgttttatctagtcacat

SEQ ID NO: 7021 - DNA, 21 bp, Homo sapiens
tgttttatctagtcacataaa

SEQ ID NO: 7022 - DNA, 21 bp, Homo sapiens
gttttatctagtcacataaat

SEQ ID NO: 7023 - DNA, 21 bp, Homo sapiens
atctagtcacataaatggatt

SEQ ID NO: 7024 - DNA, 21 bp, Homo sapiens
tctagtcacataaatggatta

SEQ ID NO: 7025 - DNA, 21 bp, Homo sapiens
cataaatggattaattactaa

SEQ ID NO: 7026 - DNA, 21 bp, Homo sapiens
ataaatggattaattactaat

SEQ ID NO: 7027 - DNA, 21 bp, Homo sapiens
tggattaattactaatttcag

SEQ ID NO: 7028 - DNA, 21 bp, Homo sapiens
gattaattactaatttcagtt

SEQ ID NO: 7029 - DNA, 21 bp, Homo sapiens
attaattactaatttcagttg

SEQ ID NO: 7030 - DNA, 21 bp, Homo sapiens
ttaattactaatttcagttga

SEQ ID NO: 7031 - DNA, 21 bp, Homo sapiens
taattggtttttactgaaaca

SEQ ID NO: 7032 - DNA, 21 bp, Homo sapiens
tggtttttactgaaacattga

SEQ ID NO: 7033 - DNA, 21 bp, Homo sapiens
ggtttttactgaaacattgag

SEQ ID NO: 7034 - DNA, 21 bp, Homo sapiens
attgagggaacacaaatttat

SEQ ID NO: 7035 - DNA, 21 bp, Homo sapiens
ttgagggaacacaaatttatg

SEQ ID NO: 7036 - DNA, 21 bp, Homo sapiens
tgatgaatgtaaagttacact

SEQ ID NO: 7037 - DNA, 21 bp, Homo sapiens
gatgaatgtaaagttacactg

SEQ ID NO: 7038 - DNA, 21 bp, Homo sapiens
ccaaaatattatattttttct

SEQ ID NO: 7039 - DNA, 21 bp, Homo sapiens
caaaatattatattttttcta

SEQ ID NO: 7040 - DNA, 21 bp, Homo sapiens
aaaatattatattttttctat

SEQ ID NO: 7041 - DNA, 21 bp, Homo sapiens
aaatattatattttttctata

SEQ ID NO: 7042 - DNA, 21 bp, Homo sapiens
atattatattttttctataaa

SEQ ID NO: 7043 - DNA, 21 bp, Homo sapiens
tattatattttttctataaaa

SEQ ID NO: 7044 - DNA, 21 bp, Homo sapiens
attatattttttctataaaaa

SEQ ID NO: 7045 - DNA, 21 bp, Homo sapiens
ttatattttttctataaaaag

SEQ ID NO: 7046 - DNA, 21 bp, Homo sapiens
tatattttttctataaaaaga

SEQ ID NO: 7047 - DNA, 21 bp, Homo sapiens
atattttttctataaaaagaa

SEQ ID NO: 7048 - DNA, 21 bp, Homo sapiens
tattttttctataaaaagaaa

SEQ ID NO: 7049 - DNA, 21 bp, Homo sapiens
attttttctataaaaagaaaa

SEQ ID NO: 7050 - DNA, 21 bp, Homo sapiens
ttctataaaaagaaaaaaatg

SEQ ID NO: 7051 - DNA, 21 bp, Homo sapiens
tctataaaaagaaaaaaatgg

SEQ ID NO: 7052 - DNA, 21 bp, Homo sapiens
tataaaaagaaaaaaatggaa

SEQ ID NO: 7053 - DNA, 21 bp, Homo sapiens
ataaaaagaaaaaaatggaaa

SEQ ID NO: 7054 - DNA, 21 bp, Homo sapiens
taaaaagaaaaaaatggaaaa

SEQ ID NO: 7055 - DNA, 21 bp, Homo sapiens
aaaaagaaaaaaatggaaaaa

SEQ ID NO: 7056 - DNA, 21 bp, Homo sapiens
aaaagaaaaaaatggaaaaaa

SEQ ID NO: 7057 - DNA, 21 bp, Homo sapiens
aaagaaaaaaatggaaaaaaa

SEQ ID NO: 7058 - DNA, 21 bp, Homo sapiens
aagaaaaaaatggaaaaaaat

SEQ ID NO: 7059 - DNA, 21 bp, Homo sapiens
aaaaaatggaaaaaaattaca

SEQ ID NO: 7060 - DNA, 21 bp, Homo sapiens
aaaaatggaaaaaaattacaa

SEQ ID NO: 7061 - DNA, 21 bp, Homo sapiens
tggaaaaaaattacaaggcaa

SEQ ID NO: 7062 - DNA, 21 bp, Homo sapiens
ggaaaaaaattacaaggcaat

SEQ ID NO: 7063 - DNA, 21 bp, Homo sapiens
gaaaaaaattacaaggcaatg

SEQ ID NO: 7064 - DNA, 21 bp, Homo sapiens
gccatttccttttcacattag

SEQ ID NO: 7065 - DNA, 21 bp, Homo sapiens
tccttttcacattagataaat

SEQ ID NO: 7066 - DNA, 21 bp, Homo sapiens
cacattagataaattactata

SEQ ID NO: 7067 - DNA, 21 bp, Homo sapiens
acattagataaattactataa

SEQ ID NO: 7068 - DNA, 21 bp, Homo sapiens
cattagataaattactataaa

SEQ ID NO: 7069 - DNA, 21 bp, Homo sapiens
agtatgaaatggggattatta

SEQ ID NO: 7070 - DNA, 21 bp, Homo sapiens
tggggattattatagcaacca

SEQ ID NO: 7071 - DNA, 21 bp, Homo sapiens
ggctatatttacatgctacta

SEQ ID NO: 7072 - DNA, 21 bp, Homo sapiens
gctatatttacatgctactaa

SEQ ID NO: 7073 - DNA, 21 bp, Homo sapiens
ctatatttacatgctactaaa

SEQ ID NO: 7074 - DNA, 21 bp, Homo sapiens
tatatttacatgctactaaat

SEQ ID NO: 7075 - DNA, 21 bp, Homo sapiens
atatttacatgctactaaatt

SEQ ID NO: 7076 - DNA, 21 bp, Homo sapiens
tacatgctactaaatttttat

SEQ ID NO: 7077 - DNA, 21 bp, Homo sapiens
tactaaatttttataataatt

SEQ ID NO: 7078 - DNA, 21 bp, Homo sapiens
actaaatttttataataattg

SEQ ID NO: 7079 - DNA, 21 bp, Homo sapiens
taaatttttataataattgaa

SEQ ID NO: 7080 - DNA, 21 bp, Homo sapiens
aaatttttataataattgaaa

SEQ ID NO: 7081 - DNA, 21 bp, Homo sapiens
aatttttataataattgaaaa

SEQ ID NO: 7082 - DNA, 21 bp, Homo sapiens
atttttataataattgaaaag

SEQ ID NO: 7083 - DNA, 21 bp, Homo sapiens
tttttataataattgaaaaga

SEQ ID NO: 7084 - DNA, 21 bp, Homo sapiens
ttttataataattgaaaagat

SEQ ID NO: 7085 - DNA, 21 bp, Homo sapiens
tttataataattgaaaagatt

SEQ ID NO: 7086 - DNA, 21 bp, Homo sapiens
ttataataattgaaaagattt

SEQ ID NO: 7087 - DNA, 21 bp, Homo sapiens
tataataattgaaaagatttt

SEQ ID NO: 7088 - DNA, 21 bp, Homo sapiens
ataattgaaaagattttaaca

SEQ ID NO: 7089 - DNA, 21 bp, Homo sapiens
taattgaaaagattttaacaa

SEQ ID NO: 7090 - DNA, 21 bp, Homo sapiens
attgaaaagattttaacaagt

SEQ ID NO: 7091 - DNA, 21 bp, Homo sapiens
ttgaaaagattttaacaagta

SEQ ID NO: 7092 - DNA, 21 bp, Homo sapiens
tgaaaagattttaacaagtat

SEQ ID NO: 7093 - DNA, 21 bp, Homo sapiens
gaaaagattttaacaagtata

SEQ ID NO: 7094 - DNA, 21 bp, Homo sapiens
aaaagattttaacaagtataa

SEQ ID NO: 7095 - DNA, 21 bp, Homo sapiens
aaagattttaacaagtataaa

SEQ ID NO: 7096 - DNA, 21 bp, Homo sapiens
aagattttaacaagtataaaa

SEQ ID NO: 7097 - DNA, 21 bp, Homo sapiens
agattttaacaagtataaaaa

SEQ ID NO: 7098 - DNA, 21 bp, Homo sapiens
gattttaacaagtataaaaaa

SEQ ID NO: 7099 - DNA, 21 bp, Homo sapiens
acaagtataaaaaattctcat

SEQ ID NO: 7100 - DNA, 21 bp, Homo sapiens
caagtataaaaaattctcata

SEQ ID NO: 7101 - DNA, 21 bp, Homo sapiens
aagtataaaaaattctcatag

SEQ ID NO: 7102 - DNA, 21 bp, Homo sapiens
agtataaaaaattctcatagg

SEQ ID NO: 7103 - DNA, 21 bp, Homo sapiens
gtataaaaaattctcatagga

SEQ ID NO: 7104 - DNA, 21 bp, Homo sapiens
tataaaaaattctcataggaa

SEQ ID NO: 7105 - DNA, 21 bp, Homo sapiens
ataaaaaattctcataggaat

SEQ ID NO: 7106 - DNA, 21 bp, Homo sapiens
taaaaaattctcataggaatt

SEQ ID NO: 7107 - DNA, 21 bp, Homo sapiens
aaaaattctcataggaattaa

SEQ ID NO: 7108 - DNA, 21 bp, Homo sapiens
aaaattctcataggaattaaa

SEQ ID NO: 7109 - DNA, 21 bp, Homo sapiens
ctctttcatagtataacttta

SEQ ID NO: 7110 - DNA, 21 bp, Homo sapiens
tcatagtataactttaaatct

SEQ ID NO: 7111 - DNA, 21 bp, Homo sapiens
catagtataactttaaatctt

SEQ ID NO: 7112 - DNA, 21 bp, Homo sapiens
tttaaatcttttcttcaactt

SEQ ID NO: 7113 - DNA, 21 bp, Homo sapiens
ttaaatcttttcttcaacttg

SEQ ID NO: 7114 - DNA, 21 bp, Homo sapiens
aacttgagtctttgaagatag

SEQ ID NO: 7115 - DNA, 21 bp, Homo sapiens
cttgagtctttgaagatagtt

SEQ ID NO: 7116 - DNA, 21 bp, Homo sapiens
ttgagtctttgaagatagttt

SEQ ID NO: 7117 - DNA, 21 bp, Homo sapiens
aagatagttttaattctgctt

SEQ ID NO: 7118 - DNA, 21 bp, Homo sapiens
agatagttttaattctgcttg

SEQ ID NO: 7119 - DNA, 21 bp, Homo sapiens
gatagttttaattctgcttgt

SEQ ID NO: 7120 - DNA, 21 bp, Homo sapiens
tgcttgtgacattaaaagatt

SEQ ID NO: 7121 - DNA, 21 bp, Homo sapiens
agcattgcttttgtttcttaa

SEQ ID NO: 7122 - DNA, 21 bp, Homo sapiens
gcattgcttttgtttcttaag

SEQ ID NO: 7123 - DNA, 21 bp, Homo sapiens
cttttgtttcttaagaaaaca

SEQ ID NO: 7124 - DNA, 21 bp, Homo sapiens
ttcttaagaaaacaaactctt

SEQ ID NO: 7125 - DNA, 21 bp, Homo sapiens
tcttaagaaaacaaactcttt

SEQ ID NO: 7126 - DNA, 21 bp, Homo sapiens
cttaagaaaacaaactctttt

SEQ ID NO: 7127 - DNA, 21 bp, Homo sapiens
ttaagaaaacaaactcttttt

SEQ ID NO: 7128 - DNA, 21 bp, Homo sapiens
taagaaaacaaactctttttt

SEQ ID NO: 7129 - DNA, 21 bp, Homo sapiens
aagaaaacaaactctttttta

SEQ ID NO: 7130 - DNA, 21 bp, Homo sapiens
agaaaacaaactcttttttaa

SEQ ID NO: 7131 - DNA, 21 bp, Homo sapiens
aacaaactcttttttaaaaat

SEQ ID NO: 7132 - DNA, 21 bp, Homo sapiens
ctcttttttaaaaattacttt

SEQ ID NO: 7133 - DNA, 21 bp, Homo sapiens
tcttttttaaaaattactttt

SEQ ID NO: 7134 - DNA, 21 bp, Homo sapiens
cttttttaaaaattactttta

SEQ ID NO: 7135 - DNA, 21 bp, Homo sapiens
ttttttaaaaattacttttaa

SEQ ID NO: 7136 - DNA, 21 bp, Homo sapiens
tttttaaaaattacttttaaa

SEQ ID NO: 7137 - DNA, 21 bp, Homo sapiens
ttttaaaaattacttttaaat

SEQ ID NO: 7138 - DNA, 21 bp, Homo sapiens
tttaaaaattacttttaaata

SEQ ID NO: 7139 - DNA, 21 bp, Homo sapiens
ttaaaaattacttttaaatat

SEQ ID NO: 7140 - DNA, 21 bp, Homo sapiens
taaaaattacttttaaatatt

SEQ ID NO: 7141 - DNA, 21 bp, Homo sapiens
tacttttaaatattaactcaa

SEQ ID NO: 7142 - DNA, 21 bp, Homo sapiens
acttttaaatattaactcaaa

SEQ ID NO: 7143 - DNA, 21 bp, Homo sapiens
ttttaaatattaactcaaaag

SEQ ID NO: 7144 - DNA, 21 bp, Homo sapiens
ttaaatattaactcaaaagtt

SEQ ID NO: 7145 - DNA, 21 bp, Homo sapiens
taaatattaactcaaaagttg

SEQ ID NO: 7146 - DNA, 21 bp, Homo sapiens
aaatattaactcaaaagttga

SEQ ID NO: 7147 - DNA, 21 bp, Homo sapiens
aatattaactcaaaagttgag

SEQ ID NO: 7148 - DNA, 21 bp, Homo sapiens
ggtgtgccaagacattaattt

SEQ ID NO: 7149 - DNA, 21 bp, Homo sapiens
gccaagacattaatttttttt

SEQ ID NO: 7150 - DNA, 21 bp, Homo sapiens
ccaagacattaattttttttt

SEQ ID NO: 7151 - DNA, 21 bp, Homo sapiens
cattaattttttttttaaaca

SEQ ID NO: 7152 - DNA, 21 bp, Homo sapiens
attaattttttttttaaacaa

SEQ ID NO: 7153 - DNA, 21 bp, Homo sapiens
taattttttttttaaacaatg

SEQ ID NO: 7154 - DNA, 21 bp, Homo sapiens
attttttttttaaacaatgaa

SEQ ID NO: 7155 - DNA, 21 bp, Homo sapiens
ttttttttttaaacaatgaag

SEQ ID NO: 7156 - DNA, 21 bp, Homo sapiens
tttttttttaaacaatgaagt

SEQ ID NO: 7157 - DNA, 21 bp, Homo sapiens
ttttttttaaacaatgaagtg

SEQ ID NO: 7158 - DNA, 21 bp, Homo sapiens
tttttttaaacaatgaagtga

SEQ ID NO: 7159 - DNA, 21 bp, Homo sapiens
tttttaaacaatgaagtgaaa

SEQ ID NO: 7160 - DNA, 21 bp, Homo sapiens
ttttaaacaatgaagtgaaaa

SEQ ID NO: 7161 - DNA, 21 bp, Homo sapiens
tttaaacaatgaagtgaaaaa

SEQ ID NO: 7162 - DNA, 21 bp, Homo sapiens
atgaagtgaaaaagttttaca

SEQ ID NO: 7163 - DNA, 21 bp, Homo sapiens
tgaaaaagttttacaatctct

SEQ ID NO: 7164 - DNA, 21 bp, Homo sapiens
gaaaaagttttacaatctcta

SEQ ID NO: 7165 - DNA, 21 bp, Homo sapiens
aaaaagttttacaatctctag

SEQ ID NO: 7166 - DNA, 21 bp, Homo sapiens
actggttaaattaacattgca

SEQ ID NO: 7167 - DNA, 21 bp, Homo sapiens
ctggttaaattaacattgcat

SEQ ID NO: 7168 - DNA, 21 bp, Homo sapiens
tggttaaattaacattgcata

SEQ ID NO: 7169 - DNA, 21 bp, Homo sapiens
acattgcataaacacttttca

SEQ ID NO: 7170 - DNA, 21 bp, Homo sapiens
tcaagtctgatccatatttaa

SEQ ID NO: 7171 - DNA, 21 bp, Homo sapiens
tccatatttaataatgcttta

SEQ ID NO: 7172 - DNA, 21 bp, Homo sapiens
ccatatttaataatgctttaa

SEQ ID NO: 7173 - DNA, 21 bp, Homo sapiens
catatttaataatgctttaaa

SEQ ID NO: 7174 - DNA, 21 bp, Homo sapiens
atatttaataatgctttaaaa

SEQ ID NO: 7175 - DNA, 21 bp, Homo sapiens
tatttaataatgctttaaaat

SEQ ID NO: 7176 - DNA, 21 bp, Homo sapiens
atttaataatgctttaaaata

SEQ ID NO: 7177 - DNA, 21 bp, Homo sapiens
ttaataatgctttaaaataaa

SEQ ID NO: 7178 - DNA, 21 bp, Homo sapiens
taataatgctttaaaataaaa

SEQ ID NO: 7179 - DNA, 21 bp, Homo sapiens
aataatgctttaaaataaaaa

SEQ ID NO: 7180 - DNA, 21 bp, Homo sapiens
ataatgctttaaaataaaaat

SEQ ID NO: 7181 - DNA, 21 bp, Homo sapiens
tttaaaataaaaataaaaaca

SEQ ID NO: 7182 - DNA, 21 bp, Homo sapiens
ataaaaataaaaacaatcctt

SEQ ID NO: 7183 - DNA, 21 bp, Homo sapiens
taaaaataaaaacaatccttt

SEQ ID NO: 7184 - DNA, 21 bp, Homo sapiens
aaaaataaaaacaatcctttt

SEQ ID NO: 7185 - DNA, 21 bp, Homo sapiens
aaaataaaaacaatccttttg

SEQ ID NO: 7186 - DNA, 21 bp, Homo sapiens
aaataaaaacaatccttttga

SEQ ID NO: 7187 - DNA, 21 bp, Homo sapiens
aataaaaacaatccttttgat

SEQ ID NO: 7188 - DNA, 21 bp, Homo sapiens
ataaaaacaatccttttgata

SEQ ID NO: 7189 - DNA, 21 bp, Homo sapiens
taaaaacaatccttttgataa

SEQ ID NO: 7190 - DNA, 21 bp, Homo sapiens
aacaatccttttgataaattt

SEQ ID NO: 7191 - DNA, 21 bp, Homo sapiens
tccttttgataaatttaaaat

SEQ ID NO: 7192 - DNA, 21 bp, Homo sapiens
ccttttgataaatttaaaatg

SEQ ID NO: 7193 - DNA, 21 bp, Homo sapiens
cttttgataaatttaaaatgt

SEQ ID NO: 7194 - DNA, 21 bp, Homo sapiens
tgataaatttaaaatgttact

SEQ ID NO: 7195 - DNA, 21 bp, Homo sapiens
gataaatttaaaatgttactt

SEQ ID NO: 7196 - DNA, 21 bp, Homo sapiens
ataaatttaaaatgttactta

SEQ ID NO: 7197 - DNA, 21 bp, Homo sapiens
taaatttaaaatgttacttat

SEQ ID NO: 7198 - DNA, 21 bp, Homo sapiens
aaatttaaaatgttacttatt

SEQ ID NO: 7199 - DNA, 21 bp, Homo sapiens
aatttaaaatgttacttattt

SEQ ID NO: 7200 - DNA, 21 bp, Homo sapiens
tttaaaatgttacttatttta

SEQ ID NO: 7201 - DNA, 21 bp, Homo sapiens
ttaaaatgttacttattttaa

SEQ ID NO: 7202 - DNA, 21 bp, Homo sapiens
taaaatgttacttattttaaa

SEQ ID NO: 7203 - DNA, 21 bp, Homo sapiens
aaaatgttacttattttaaaa

SEQ ID NO: 7204 - DNA, 21 bp, Homo sapiens
aaatgttacttattttaaaat

SEQ ID NO: 7205 - DNA, 21 bp, Homo sapiens
atgttacttattttaaaataa

SEQ ID NO: 7206 - DNA, 21 bp, Homo sapiens
acttattttaaaataaatgaa

SEQ ID NO: 7207 - DNA, 21 bp, Homo sapiens
ttattttaaaataaatgaagt

SEQ ID NO: 7208 - DNA, 21 bp, Homo sapiens
tattttaaaataaatgaagtg

SEQ ID NO: 7209 - DNA, 21 bp, Homo sapiens
tttaaaataaatgaagtgaga

SEQ ID NO: 7210 - DNA, 21 bp, Homo sapiens
ttaaaataaatgaagtgagat

SEQ ID NO: 7211 - DNA, 21 bp, Homo sapiens
tccatttcttcatgttaaaag

SEQ ID NO: 7212 - DNA, 21 bp, Homo sapiens
ccatttcttcatgttaaaaga

SEQ ID NO: 7213 - DNA, 21 bp, Homo sapiens
ctcaaactcttagtttttttt

SEQ ID NO: 7214 - DNA, 21 bp, Homo sapiens
tagttttttttttttacaact

SEQ ID NO: 7215 - DNA, 21 bp, Homo sapiens
agttttttttttttacaacta

SEQ ID NO: 7216 - DNA, 21 bp, Homo sapiens
gttttttttttttacaactat

SEQ ID NO: 7217 - DNA, 21 bp, Homo sapiens
ttttttttttttacaactatg

SEQ ID NO: 7218 - DNA, 21 bp, Homo sapiens
tttttttttttacaactatgt

SEQ ID NO: 7219 - DNA, 21 bp, Homo sapiens
ttttttttttacaactatgta

SEQ ID NO: 7220 - DNA, 21 bp, Homo sapiens
tttttttttacaactatgtaa

SEQ ID NO: 7221 - DNA, 21 bp, Homo sapiens
ttttttttacaactatgtaat

SEQ ID NO: 7222 - DNA, 21 bp, Homo sapiens
tttttttacaactatgtaatt

SEQ ID NO: 7223 - DNA, 21 bp, Homo sapiens
ttttttacaactatgtaattt

SEQ ID NO: 7224 - DNA, 21 bp, Homo sapiens
tttttacaactatgtaattta

SEQ ID NO: 7225 - DNA, 21 bp, Homo sapiens
aactatgtaatttatattcca

SEQ ID NO: 7226 - DNA, 21 bp, Homo sapiens
actatgtaatttatattccat

SEQ ID NO: 7227 - DNA, 21 bp, Homo sapiens
ctatgtaatttatattccatt

SEQ ID NO: 7228 - DNA, 21 bp, Homo sapiens
aatttatattccatttacata

SEQ ID NO: 7229 - DNA, 21 bp, Homo sapiens
atttatattccatttacataa

SEQ ID NO: 7230 - DNA, 21 bp, Homo sapiens
tttatattccatttacataag

SEQ ID NO: 7231 - DNA, 21 bp, Homo sapiens
ttatattccatttacataagg

SEQ ID NO: 7232 - DNA, 21 bp, Homo sapiens
tacataaggatacacttattt

SEQ ID NO: 7233 - DNA, 21 bp, Homo sapiens
taaggatacacttatttgtca

SEQ ID NO: 7234 - DNA, 21 bp, Homo sapiens
atctgtaaatttttaacctat

SEQ ID NO: 7235 - DNA, 21 bp, Homo sapiens
tctgtaaatttttaacctatg

SEQ ID NO: 7236 - DNA, 21 bp, Homo sapiens
ctgtaaatttttaacctatgt

SEQ ID NO: 7237 - DNA, 21 bp, Homo sapiens
tgcaagaggtgaagtttatat

SEQ ID NO: 7238 - DNA, 21 bp, Homo sapiens
caagaggtgaagtttatattt

SEQ ID NO: 7239 - DNA, 21 bp, Homo sapiens
aagaggtgaagtttatatttg

SEQ ID NO: 7240 - DNA, 21 bp, Homo sapiens
gaggtgaagtttatatttgaa

SEQ ID NO: 7241 - DNA, 21 bp, Homo sapiens
aggtgaagtttatatttgaat

SEQ ID NO: 7242 - DNA, 21 bp, Homo sapiens
aagtttatatttgaatatcca

SEQ ID NO: 7243 - DNA, 21 bp, Homo sapiens
acttgatgcagttttaatact

SEQ ID NO: 7244 - DNA, 21 bp, Homo sapiens
ttgatgcagttttaatacttg

SEQ ID NO: 7245 - DNA, 21 bp, Homo sapiens
gatttgacctaatcactaatt

SEQ ID NO: 7246 - DNA, 21 bp, Homo sapiens
acctaatcactaattttcagg

SEQ ID NO: 7247 - DNA, 21 bp, Homo sapiens
cagtaggatttttcaaacctg

SEQ ID NO: 7248 - DNA, 21 bp, Homo sapiens
agtggaaggagaatttaataa

SEQ ID NO: 7249 - DNA, 21 bp, Homo sapiens
ggaaggagaatttaataaaga

SEQ ID NO: 7250 - DNA, 21 bp, Homo sapiens
aaggagaatttaataaagata

SEQ ID NO: 7251 - DNA, 21 bp, Homo sapiens
aggagaatttaataaagatag

SEQ ID NO: 7252 - DNA, 21 bp, Homo sapiens
gaatttaataaagatagtgct

SEQ ID NO: 7253 - DNA, 21 bp, Homo sapiens
tccttaggtaatctataacta

SEQ ID NO: 7254 - DNA, 21 bp, Homo sapiens
ccttaggtaatctataactag

SEQ ID NO: 7255 - DNA, 21 bp, Homo sapiens
aacagtaatacattccattgt

SEQ ID NO: 7256 - DNA, 21 bp, Homo sapiens
cagtaatacattccattgttt

SEQ ID NO: 7257 - DNA, 21 bp, Homo sapiens
agtaatacattccattgtttt

SEQ ID NO: 7258 - DNA, 21 bp, Homo sapiens
gtaatacattccattgtttta

SEQ ID NO: 7259 - DNA, 21 bp, Homo sapiens
ccattgttttagtaaccagaa

SEQ ID NO: 7260 - DNA, 21 bp, Homo sapiens
accagaaatcttcatgcaatg

SEQ ID NO: 7261 - DNA, 21 bp, Homo sapiens
ttcatgcaatgaaaaatactt

SEQ ID NO: 7262 - DNA, 21 bp, Homo sapiens
aatgaaaaatactttaattca

SEQ ID NO: 7263 - DNA, 21 bp, Homo sapiens
tgaaaaatactttaattcatg

SEQ ID NO: 7264 - DNA, 21 bp, Homo sapiens
gaaaaatactttaattcatga

SEQ ID NO: 7265 - DNA, 21 bp, Homo sapiens
ttcatgaagcttacttttttt

SEQ ID NO: 7266 - DNA, 21 bp, Homo sapiens
atgaagcttactttttttttt

SEQ ID NO: 7267 - DNA, 21 bp, Homo sapiens
agcttactttttttttttggt

SEQ ID NO: 7268 - DNA, 21 bp, Homo sapiens
tactttttttttttggtgtca

SEQ ID NO: 7269 - DNA, 21 bp, Homo sapiens
actttttttttttggtgtcag

SEQ ID NO: 7270 - DNA, 21 bp, Homo sapiens
aactaatttttgtatttttag

SEQ ID NO: 7271 - DNA, 21 bp, Homo sapiens
taatttttgtatttttaggag

SEQ ID NO: 7272 - DNA, 21 bp, Homo sapiens
ctcatttattcagcaaatatt

SEQ ID NO: 7273 - DNA, 21 bp, Homo sapiens
catttattcagcaaatattta

SEQ ID NO: 7274 - DNA, 21 bp, Homo sapiens
tttattcagcaaatatttatt

SEQ ID NO: 7275 - DNA, 21 bp, Homo sapiens
tattttagttttgcaaagaag

SEQ ID NO: 7276 - DNA, 21 bp, Homo sapiens
ctctataattgttttgctacg

SEQ ID NO: 7277 - DNA, 21 bp, Homo sapiens
tactttatgtaaatcacttca

SEQ ID NO: 7278 - DNA, 21 bp, Homo sapiens
actttatgtaaatcacttcat

SEQ ID NO: 7279 - DNA, 21 bp, Homo sapiens
ctttatgtaaatcacttcatt

SEQ ID NO: 7280 - DNA, 21 bp, Homo sapiens
tttatgtaaatcacttcattg

SEQ ID NO: 7281 - DNA, 21 bp, Homo sapiens
ttatgtaaatcacttcattgt

SEQ ID NO: 7282 - DNA, 21 bp, Homo sapiens
tatgtaaatcacttcattgtt

SEQ ID NO: 7283 - DNA, 21 bp, Homo sapiens
atgtaaatcacttcattgttt

SEQ ID NO: 7284 - DNA, 21 bp, Homo sapiens
attgttttaaaggaataaact

SEQ ID NO: 7285 - DNA, 21 bp, Homo sapiens
ttgttttaaaggaataaactt

SEQ ID NO: 7286 - DNA, 21 bp, Homo sapiens
ttttaaaggaataaacttgat

SEQ ID NO: 7287 - DNA, 21 bp, Homo sapiens
tttaaaggaataaacttgatt

SEQ ID NO: 7288 - DNA, 21 bp, Homo sapiens
ttaaaggaataaacttgatta

SEQ ID NO: 7289 - DNA, 21 bp, Homo sapiens
aaaggaataaacttgattata

SEQ ID NO: 7290 - DNA, 21 bp, Homo sapiens
aaggaataaacttgattatat

SEQ ID NO: 7291 - DNA, 21 bp, Homo sapiens
aggaataaacttgattatatt

SEQ ID NO: 7292 - DNA, 21 bp, Homo sapiens
ggaataaacttgattatattg

SEQ ID NO: 7293 - DNA, 21 bp, Homo sapiens
gaataaacttgattatattgt

SEQ ID NO: 7294 - DNA, 21 bp, Homo sapiens
aacttgattatattgtttttt

SEQ ID NO: 7295 - DNA, 21 bp, Homo sapiens
acttgattatattgttttttt

SEQ ID NO: 7296 - DNA, 21 bp, Homo sapiens
tgattatattgtttttttatt

SEQ ID NO: 7297 - DNA, 21 bp, Homo sapiens
atattgtttttttatttggca

SEQ ID NO: 7298 - DNA, 21 bp, Homo sapiens
tattgtttttttatttggcat

SEQ ID NO: 7299 - DNA, 21 bp, Homo sapiens
gtttttttatttggcataact

SEQ ID NO: 7300 - DNA, 21 bp, Homo sapiens
tttttttatttggcataactg

SEQ ID NO: 7301 - DNA, 21 bp, Homo sapiens
gcataactgtgattcttttag

SEQ ID NO: 7302 - DNA, 21 bp, Homo sapiens
actgtgattcttttaggacaa

SEQ ID NO: 7303 - DNA, 21 bp, Homo sapiens
ctgtgattcttttaggacaat

SEQ ID NO: 7304 - DNA, 21 bp, Homo sapiens
ggtgtatgtcagatattcata

SEQ ID NO: 7305 - DNA, 21 bp, Homo sapiens
gtgtatgtcagatattcatat

SEQ ID NO: 7306 - DNA, 21 bp, Homo sapiens
caaatgtgtaatattccagtt

SEQ ID NO: 7307 - DNA, 21 bp, Homo sapiens
cataagtaattaaaatatact

SEQ ID NO: 7308 - DNA, 21 bp, Homo sapiens
ataagtaattaaaatatactt

SEQ ID NO: 7309 - DNA, 21 bp, Homo sapiens
taagtaattaaaatatactta

SEQ ID NO: 7310 - DNA, 21 bp, Homo sapiens
aagtaattaaaatatacttaa

SEQ ID NO: 7311 - DNA, 21 bp, Homo sapiens
agtaattaaaatatacttaaa

SEQ ID NO: 7312 - DNA, 21 bp, Homo sapiens
gtaattaaaatatacttaaaa

SEQ ID NO: 7313 - DNA, 21 bp, Homo sapiens
taattaaaatatacttaaaaa

SEQ ID NO: 7314 - DNA, 21 bp, Homo sapiens
aattaaaatatacttaaaaat

SEQ ID NO: 7315 - DNA, 21 bp, Homo sapiens
attaaaatatacttaaaaatt

SEQ ID NO: 7316 - DNA, 21 bp, Homo sapiens
taaaatatacttaaaaattaa

SEQ ID NO: 7317 - DNA, 21 bp, Homo sapiens
aaaatatacttaaaaattaat

SEQ ID NO: 7318 - DNA, 21 bp, Homo sapiens
aaatatacttaaaaattaata

SEQ ID NO: 7319 - DNA, 21 bp, Homo sapiens
aatatacttaaaaattaatag

SEQ ID NO: 7320 - DNA, 21 bp, Homo sapiens
tacttaaaaattaatagtttt

SEQ ID NO: 7321 - DNA, 21 bp, Homo sapiens
taaaaattaatagttttatct

SEQ ID NO: 7322 - DNA, 21 bp, Homo sapiens
aaaaattaatagttttatctg

SEQ ID NO: 7323 - DNA, 21 bp, Homo sapiens
aaaattaatagttttatctgg

SEQ ID NO: 7324 - DNA, 21 bp, Homo sapiens
atctgggtacaaataaacagg

SEQ ID NO: 7325 - DNA, 21 bp, Homo sapiens
gacaaggaaacttctatgtaa

SEQ ID NO: 7326 - DNA, 21 bp, Homo sapiens
acaaggaaacttctatgtaaa

SEQ ID NO: 7327 - DNA, 21 bp, Homo sapiens
caaggaaacttctatgtaaaa

SEQ ID NO: 7328 - DNA, 21 bp, Homo sapiens
ttctatgtaaaaatcactatg

SEQ ID NO: 7329 - DNA, 21 bp, Homo sapiens
tctatgtaaaaatcactatga

SEQ ID NO: 7330 - DNA, 21 bp, Homo sapiens
ctatgtaaaaatcactatgat

SEQ ID NO: 7331 - DNA, 21 bp, Homo sapiens
gtaaaaatcactatgatttct

SEQ ID NO: 7332 - DNA, 21 bp, Homo sapiens
taaaaatcactatgatttctg

SEQ ID NO: 7333 - DNA, 21 bp, Homo sapiens
ctatgatttctgaattgctat

SEQ ID NO: 7334 - DNA, 21 bp, Homo sapiens
tatgatttctgaattgctatg

SEQ ID NO: 7335 - DNA, 21 bp, Homo sapiens
tatgtgaaactacagatcttt

SEQ ID NO: 7336 - DNA, 21 bp, Homo sapiens
atgtgaaactacagatctttg

SEQ ID NO: 7337 - DNA, 21 bp, Homo sapiens
agggtgttaagacttacacag

SEQ ID NO: 7338 - DNA, 21 bp, Homo sapiens
tttaggcctcttgaatttttg

SEQ ID NO: 7339 - DNA, 21 bp, Homo sapiens
tcttgaatttttgatgtagat

SEQ ID NO: 7340 - DNA, 21 bp, Homo sapiens
cttgaatttttgatgtagatg

SEQ ID NO: 7341 - DNA, 21 bp, Homo sapiens
tagatgggcatttttttaagg

SEQ ID NO: 7342 - DNA, 21 bp, Homo sapiens
ggcatttttttaaggtagtgg

SEQ ID NO: 7343 - DNA, 21 bp, Homo sapiens
aggtagtggttaattaccttt

SEQ ID NO: 7344 - DNA, 21 bp, Homo sapiens
gtagtggttaattacctttat

SEQ ID NO: 7345 - DNA, 21 bp, Homo sapiens
tagtggttaattacctttatg

SEQ ID NO: 7346 - DNA, 21 bp, Homo sapiens
agtggttaattacctttatgt

SEQ ID NO: 7347 - DNA, 21 bp, Homo sapiens
gtggttaattacctttatgtg

SEQ ID NO: 7348 - DNA, 21 bp, Homo sapiens
acctttatgtgaactttgaat

SEQ ID NO: 7349 - DNA, 21 bp, Homo sapiens
tatgtgaactttgaatggttt

SEQ ID NO: 7350 - DNA, 21 bp, Homo sapiens
aactttgaatggtttaacaaa

SEQ ID NO: 7351 - DNA, 21 bp, Homo sapiens
ttgaatggtttaacaaaagat

SEQ ID NO: 7352 - DNA, 21 bp, Homo sapiens
tgaatggtttaacaaaagatt

SEQ ID NO: 7353 - DNA, 21 bp, Homo sapiens
gaatggtttaacaaaagattt

SEQ ID NO: 7354 - DNA, 21 bp, Homo sapiens
aatggtttaacaaaagatttg

SEQ ID NO: 7355 - DNA, 21 bp, Homo sapiens
atggtttaacaaaagatttgt

SEQ ID NO: 7356 - DNA, 21 bp, Homo sapiens
ggtttaacaaaagatttgttt

SEQ ID NO: 7357 - DNA, 21 bp, Homo sapiens
gtttaacaaaagatttgtttt

SEQ ID NO: 7358 - DNA, 21 bp, Homo sapiens
aacaaaagatttgtttttgta

SEQ ID NO: 7359 - DNA, 21 bp, Homo sapiens
acaaaagatttgtttttgtag

SEQ ID NO: 7360 - DNA, 21 bp, Homo sapiens
caaaagatttgtttttgtaga

SEQ ID NO: 7361 - DNA, 21 bp, Homo sapiens
aaagatttgtttttgtagaga

SEQ ID NO: 7362 - DNA, 21 bp, Homo sapiens
aagatttgtttttgtagagat

SEQ ID NO: 7363 - DNA, 21 bp, Homo sapiens
agatttgtttttgtagagatt

SEQ ID NO: 7364 - DNA, 21 bp, Homo sapiens
gatttgtttttgtagagattt

SEQ ID NO: 7365 - DNA, 21 bp, Homo sapiens
tttttgtagagattttaaagg

SEQ ID NO: 7366 - DNA, 21 bp, Homo sapiens
aagggggagaattctagaaat

SEQ ID NO: 7367 - DNA, 21 bp, Homo sapiens
gggggagaattctagaaataa

SEQ ID NO: 7368 - DNA, 21 bp, Homo sapiens
ggggagaattctagaaataaa

SEQ ID NO: 7369 - DNA, 21 bp, Homo sapiens
gggagaattctagaaataaat

SEQ ID NO: 7370 - DNA, 21 bp, Homo sapiens
ggagaattctagaaataaatg

SEQ ID NO: 7371 - DNA, 21 bp, Homo sapiens
gagaattctagaaataaatgt

SEQ ID NO: 7372 - DNA, 21 bp, Homo sapiens
ttctagaaataaatgttacct

SEQ ID NO: 7373 - DNA, 21 bp, Homo sapiens
tctagaaataaatgttaccta

SEQ ID NO: 7374 - DNA, 21 bp, Homo sapiens
ctagaaataaatgttacctaa

SEQ ID NO: 7375 - DNA, 21 bp, Homo sapiens
tagaaataaatgttacctaat

SEQ ID NO: 7376 - DNA, 21 bp, Homo sapiens
agaaataaatgttacctaatt

SEQ ID NO: 7377 - DNA, 21 bp, Homo sapiens
aaataaatgttacctaattat

SEQ ID NO: 7378 - DNA, 21 bp, Homo sapiens
acctaattattacagccttaa

SEQ ID NO: 7379 - DNA, 21 bp, Homo sapiens
cctaattattacagccttaaa

SEQ ID NO: 7380 - DNA, 21 bp, Homo sapiens
ccttaaagacaaaaatccttg

SEQ ID NO: 7381 - DNA, 21 bp, Homo sapiens
taaagacaaaaatccttgttg

SEQ ID NO: 7382 - DNA, 21 bp, Homo sapiens
tccttgttgaagtttttttaa

SEQ ID NO: 7383 - DNA, 21 bp, Homo sapiens
ccttgttgaagtttttttaaa

SEQ ID NO: 7384 - DNA, 21 bp, Homo sapiens
ttgttgaagtttttttaaaaa

SEQ ID NO: 7385 - DNA, 21 bp, Homo sapiens
tgttgaagtttttttaaaaaa

SEQ ID NO: 7386 - DNA, 21 bp, Homo sapiens
gaagtttttttaaaaaaagct

SEQ ID NO: 7387 - DNA, 21 bp, Homo sapiens
aagtttttttaaaaaaagcta

SEQ ID NO: 7388 - DNA, 21 bp, Homo sapiens
agtttttttaaaaaaagctaa

SEQ ID NO: 7389 - DNA, 21 bp, Homo sapiens
gtttttttaaaaaaagctaaa

SEQ ID NO: 7390 - DNA, 21 bp, Homo sapiens
tttttttaaaaaaagctaaat

SEQ ID NO: 7391 - DNA, 21 bp, Homo sapiens
tttaaaaaaagctaaattaca

SEQ ID NO: 7392 - DNA, 21 bp, Homo sapiens
taaaaaaagctaaattacata

SEQ ID NO: 7393 - DNA, 21 bp, Homo sapiens
acttaggcattaacatgtttg

SEQ ID NO: 7394 - DNA, 21 bp, Homo sapiens
cttaggcattaacatgtttgt

SEQ ID NO: 7395 - DNA, 21 bp, Homo sapiens
agcagacgtatattgtatcat

SEQ ID NO: 7396 - DNA, 21 bp, Homo sapiens
gacgtatattgtatcatttga

SEQ ID NO: 7397 - DNA, 21 bp, Homo sapiens
cgtatattgtatcatttgagt

SEQ ID NO: 7398 - DNA, 21 bp, Homo sapiens
atattgtatcatttgagtgaa

SEQ ID NO: 7399 - DNA, 21 bp, Homo sapiens
tattgtatcatttgagtgaat

SEQ ID NO: 7400 - DNA, 21 bp, Homo sapiens
attgtatcatttgagtgaatg

SEQ ID NO: 7401 - DNA, 21 bp, Homo sapiens
ataggaatttagaacctaact

SEQ ID NO: 7402 - DNA, 21 bp, Homo sapiens
taggaatttagaacctaactt

SEQ ID NO: 7403 - DNA, 21 bp, Homo sapiens
aatttagaacctaacttttat

SEQ ID NO: 7404 - DNA, 21 bp, Homo sapiens
atttagaacctaacttttata

SEQ ID NO: 7405 - DNA, 21 bp, Homo sapiens
tttagaacctaacttttatag

SEQ ID NO: 7406 - DNA, 21 bp, Homo sapiens
ttagaacctaacttttatagg

SEQ ID NO: 7407 - DNA, 21 bp, Homo sapiens
ttttataggttatcaaaactg

SEQ ID NO: 7408 - DNA, 21 bp, Homo sapiens
ttataggttatcaaaactgtt

SEQ ID NO: 7409 - DNA, 21 bp, Homo sapiens
aattttgtcctaatatataca

SEQ ID NO: 7410 - DNA, 21 bp, Homo sapiens
attttgtcctaatatatacat

SEQ ID NO: 7411 - DNA, 21 bp, Homo sapiens
ttttgtcctaatatatacata

SEQ ID NO: 7412 - DNA, 21 bp, Homo sapiens
cctaatatatacatagaaact

SEQ ID NO: 7413 - DNA, 21 bp, Homo sapiens
tatatacatagaaactttgtg

SEQ ID NO: 7414 - DNA, 21 bp, Homo sapiens
cacaagttcatctcatttgta

SEQ ID NO: 7415 - DNA, 21 bp, Homo sapiens
ctcatttgtattccattgatt

SEQ ID NO: 7416 - DNA, 21 bp, Homo sapiens
tcatttgtattccattgattt

SEQ ID NO: 7417 - DNA, 21 bp, Homo sapiens
catttgtattccattgatttt

SEQ ID NO: 7418 - DNA, 21 bp, Homo sapiens
atttgtattccattgattttt

SEQ ID NO: 7419 - DNA, 21 bp, Homo sapiens
tttgtattccattgatttttt

SEQ ID NO: 7420 - DNA, 21 bp, Homo sapiens
ttgtattccattgattttttt

SEQ ID NO: 7421 - DNA, 21 bp, Homo sapiens
tgtattccattgatttttttt

SEQ ID NO: 7422 - DNA, 21 bp, Homo sapiens
cattgattttttttttcttct

SEQ ID NO: 7423 - DNA, 21 bp, Homo sapiens
attgattttttttttcttcta

SEQ ID NO: 7424 - DNA, 21 bp, Homo sapiens
attttttttttcttctaaaca

SEQ ID NO: 7425 - DNA, 21 bp, Homo sapiens
ttttttttttcttctaaacat

SEQ ID NO: 7426 - DNA, 21 bp, Homo sapiens
tttttttttcttctaaacatt

SEQ ID NO: 7427 - DNA, 21 bp, Homo sapiens
ttttttttcttctaaacattt

SEQ ID NO: 7428 - DNA, 21 bp, Homo sapiens
tttttttcttctaaacatttt

SEQ ID NO: 7429 - DNA, 21 bp, Homo sapiens
aacattttttcttcaaacagt

SEQ ID NO: 7430 - DNA, 21 bp, Homo sapiens
acattttttcttcaaacagta

SEQ ID NO: 7431 - DNA, 21 bp, Homo sapiens
cattttttcttcaaacagtat

SEQ ID NO: 7432 - DNA, 21 bp, Homo sapiens
attttttcttcaaacagtata

SEQ ID NO: 7433 - DNA, 21 bp, Homo sapiens
ttttttcttcaaacagtatat

SEQ ID NO: 7434 - DNA, 21 bp, Homo sapiens
ttcaaacagtatataactttt

SEQ ID NO: 7435 - DNA, 21 bp, Homo sapiens
acagtatataactttttttag

SEQ ID NO: 7436 - DNA, 21 bp, Homo sapiens
cagtatataactttttttagg

SEQ ID NO: 7437 - DNA, 21 bp, Homo sapiens
agtatataactttttttaggg

SEQ ID NO: 7438 - DNA, 21 bp, Homo sapiens
gtatataactttttttagggg

SEQ ID NO: 7439 - DNA, 21 bp, Homo sapiens
aactttttttaggggattttt

SEQ ID NO: 7440 - DNA, 21 bp, Homo sapiens
actttttttaggggatttttt

SEQ ID NO: 7441 - DNA, 21 bp, Homo sapiens
gggatttttttttagacagca

SEQ ID NO: 7442 - DNA, 21 bp, Homo sapiens
ggatttttttttagacagcaa

SEQ ID NO: 7443 - DNA, 21 bp, Homo sapiens
gatttttttttagacagcaaa

SEQ ID NO: 7444 - DNA, 21 bp, Homo sapiens
tgaagatttccatttgtcaaa

SEQ ID NO: 7445 - DNA, 21 bp, Homo sapiens
gaagatttccatttgtcaaaa

SEQ ID NO: 7446 - DNA, 21 bp, Homo sapiens
aagatttccatttgtcaaaaa

SEQ ID NO: 7447 - DNA, 21 bp, Homo sapiens
agatttccatttgtcaaaaag

SEQ ID NO: 7448 - DNA, 21 bp, Homo sapiens
tccatttgtcaaaaagtaatg

SEQ ID NO: 7449 - DNA, 21 bp, Homo sapiens
ccatttgtcaaaaagtaatga

SEQ ID NO: 7450 - DNA, 21 bp, Homo sapiens
catttgtcaaaaagtaatgat

SEQ ID NO: 7451 - DNA, 21 bp, Homo sapiens
gtcaaaaagtaatgatttctt

SEQ ID NO: 7452 - DNA, 21 bp, Homo sapiens
tcaaaaagtaatgatttcttg

SEQ ID NO: 7453 - DNA, 21 bp, Homo sapiens
caaaaagtaatgatttcttga

SEQ ID NO: 7454 - DNA, 21 bp, Homo sapiens
aaaaagtaatgatttcttgat

SEQ ID NO: 7455 - DNA, 21 bp, Homo sapiens
aaagtaatgatttcttgataa

SEQ ID NO: 7456 - DNA, 21 bp, Homo sapiens
agtaatgatttcttgataatt

SEQ ID NO: 7457 - DNA, 21 bp, Homo sapiens
gtaatgatttcttgataattg

SEQ ID NO: 7458 - DNA, 21 bp, Homo sapiens
aatgatttcttgataattgtg

SEQ ID NO: 7459 - DNA, 21 bp, Homo sapiens
atgatttcttgataattgtgt

SEQ ID NO: 7460 - DNA, 21 bp, Homo sapiens
ttcttgataattgtgtagtaa

SEQ ID NO: 7461 - DNA, 21 bp, Homo sapiens
tcttgataattgtgtagtaat

SEQ ID NO: 7462 - DNA, 21 bp, Homo sapiens
cttgataattgtgtagtaatg

SEQ ID NO: 7463 - DNA, 21 bp, Homo sapiens
tgataattgtgtagtaatgtt

SEQ ID NO: 7464 - DNA, 21 bp, Homo sapiens
taattgtgtagtaatgttttt

SEQ ID NO: 7465 - DNA, 21 bp, Homo sapiens
attgtgtagtaatgtttttta

SEQ ID NO: 7466 - DNA, 21 bp, Homo sapiens
ttgtgtagtaatgttttttag

SEQ ID NO: 7467 - DNA, 21 bp, Homo sapiens
ccttaaagctgaatttatatt

SEQ ID NO: 7468 - DNA, 21 bp, Homo sapiens
ttaaagctgaatttatattta

SEQ ID NO: 7469 - DNA, 21 bp, Homo sapiens
aatttatatttagtaacttct

SEQ ID NO: 7470 - DNA, 21 bp, Homo sapiens
atttatatttagtaacttctg

SEQ ID NO: 7471 - DNA, 21 bp, Homo sapiens
tttatatttagtaacttctgt

SEQ ID NO: 7472 - DNA, 21 bp, Homo sapiens
atttagtaacttctgtgttaa

SEQ ID NO: 7473 - DNA, 21 bp, Homo sapiens
actgaatagctgtcataaaat

SEQ ID NO: 7474 - DNA, 21 bp, Homo sapiens
ctgaatagctgtcataaaatg

SEQ ID NO: 7475 - DNA, 21 bp, Homo sapiens
taaaatgaaactttctttcta

SEQ ID NO: 7476 - DNA, 21 bp, Homo sapiens
aaaatgaaactttctttctaa

SEQ ID NO: 7477 - DNA, 21 bp, Homo sapiens
aaatgaaactttctttctaaa

SEQ ID NO: 7478 - DNA, 21 bp, Homo sapiens
atgaaactttctttctaaaga

SEQ ID NO: 7479 - DNA, 21 bp, Homo sapiens
aactttctttctaaagaaaga

SEQ ID NO: 7480 - DNA, 21 bp, Homo sapiens
cacatgagttcttgaagaata

SEQ ID NO: 7481 - DNA, 21 bp, Homo sapiens
tcttgaagaatagtcataact

SEQ ID NO: 7482 - DNA, 21 bp, Homo sapiens
cttgaagaatagtcataacta

SEQ ID NO: 7483 - DNA, 21 bp, Homo sapiens
ttgaagaatagtcataactag

SEQ ID NO: 7484 - DNA, 21 bp, Homo sapiens
aagaatagtcataactagatt

SEQ ID NO: 7485 - DNA, 21 bp, Homo sapiens
agaatagtcataactagatta

SEQ ID NO: 7486 - DNA, 21 bp, Homo sapiens
gaatagtcataactagattaa

SEQ ID NO: 7487 - DNA, 21 bp, Homo sapiens
aatagtcataactagattaag

SEQ ID NO: 7488 - DNA, 21 bp, Homo sapiens
gtcataactagattaagatct

SEQ ID NO: 7489 - DNA, 21 bp, Homo sapiens
actagattaagatctgtgttt

SEQ ID NO: 7490 - DNA, 21 bp, Homo sapiens
tagattaagatctgtgtttta

SEQ ID NO: 7491 - DNA, 21 bp, Homo sapiens
agattaagatctgtgttttag

SEQ ID NO: 7492 - DNA, 21 bp, Homo sapiens
attaagatctgtgttttagtt

SEQ ID NO: 7493 - DNA, 21 bp, Homo sapiens
tctgtgttttagtttaatagt

SEQ ID NO: 7494 - DNA, 21 bp, Homo sapiens
ctgtgttttagtttaatagtt

SEQ ID NO: 7495 - DNA, 21 bp, Homo sapiens
gtgttttagtttaatagtttg

SEQ ID NO: 7496 - DNA, 21 bp, Homo sapiens
gttttagtttaatagtttgaa

SEQ ID NO: 7497 - DNA, 21 bp, Homo sapiens
ttttagtttaatagtttgaag

SEQ ID NO: 7498 - DNA, 21 bp, Homo sapiens
gtttgggataatgataggtaa

SEQ ID NO: 7499 - DNA, 21 bp, Homo sapiens
ttgggataatgataggtaatt

SEQ ID NO: 7500 - DNA, 21 bp, Homo sapiens
ggataatgataggtaatttag

SEQ ID NO: 7501 - DNA, 21 bp, Homo sapiens
gataatgataggtaatttaga

SEQ ID NO: 7502 - DNA, 21 bp, Homo sapiens
aatgataggtaatttagatga

SEQ ID NO: 7503 - DNA, 21 bp, Homo sapiens
atgataggtaatttagatgaa

SEQ ID NO: 7504 - DNA, 21 bp, Homo sapiens
aggtaatttagatgaatttag

SEQ ID NO: 7505 - DNA, 21 bp, Homo sapiens
gtaatttagatgaatttaggg

SEQ ID NO: 7506 - DNA, 21 bp, Homo sapiens
agatgaatttaggggaaaaaa

SEQ ID NO: 7507 - DNA, 21 bp, Homo sapiens
gatgaatttaggggaaaaaaa

SEQ ID NO: 7508 - DNA, 21 bp, Homo sapiens
gggaaaaaaaagttatctgca

SEQ ID NO: 7509 - DNA, 21 bp, Homo sapiens
ggaaaaaaaagttatctgcag

SEQ ID NO: 7510 - DNA, 21 bp, Homo sapiens
aaaaagttatctgcagatatg

SEQ ID NO: 7511 - DNA, 21 bp, Homo sapiens
gtcttgtgttttcatgttgaa

SEQ ID NO: 7512 - DNA, 21 bp, Homo sapiens
tcttgtgttttcatgttgaaa

SEQ ID NO: 7513 - DNA, 21 bp, Homo sapiens
cttgtgttttcatgttgaaaa

SEQ ID NO: 7514 - DNA, 21 bp, Homo sapiens
catgttgaaaatacttttgca

SEQ ID NO: 7515 - DNA, 21 bp, Homo sapiens
atgttgaaaatacttttgcat

SEQ ID NO: 7516 - DNA, 21 bp, Homo sapiens
tgttgaaaatacttttgcatt

SEQ ID NO: 7517 - DNA, 21 bp, Homo sapiens
gttgaaaatacttttgcattt

SEQ ID NO: 7518 - DNA, 21 bp, Homo sapiens
cttttgcatttttcctttgag

SEQ ID NO: 7519 - DNA, 21 bp, Homo sapiens
tgagtgccaatttcttactag

SEQ ID NO: 7520 - DNA, 21 bp, Homo sapiens
gccaatttcttactagtacta

SEQ ID NO: 7521 - DNA, 21 bp, Homo sapiens
ccaatttcttactagtactat

SEQ ID NO: 7522 - DNA, 21 bp, Homo sapiens
tactagtactatttcttaatg

SEQ ID NO: 7523 - DNA, 21 bp, Homo sapiens
actagtactatttcttaatgt

SEQ ID NO: 7524 - DNA, 21 bp, Homo sapiens
tactatttcttaatgtaacat

SEQ ID NO: 7525 - DNA, 21 bp, Homo sapiens
actatttcttaatgtaacatg

SEQ ID NO: 7526 - DNA, 21 bp, Homo sapiens
ctatttcttaatgtaacatgt

SEQ ID NO: 7527 - DNA, 21 bp, Homo sapiens
ttaatgtaacatgtttacctg

SEQ ID NO: 7528 - DNA, 21 bp, Homo sapiens
cctggaatgtattttaactat

SEQ ID NO: 7529 - DNA, 21 bp, Homo sapiens
tggaatgtattttaactattt

SEQ ID NO: 7530 - DNA, 21 bp, Homo sapiens
ggaatgtattttaactatttt

SEQ ID NO: 7531 - DNA, 21 bp, Homo sapiens
gaatgtattttaactattttt

SEQ ID NO: 7532 - DNA, 21 bp, Homo sapiens
aatgtattttaactatttttg

SEQ ID NO: 7533 - DNA, 21 bp, Homo sapiens
tgtattttaactatttttgta

SEQ ID NO: 7534 - DNA, 21 bp, Homo sapiens
tattttaactatttttgtata

SEQ ID NO: 7535 - DNA, 21 bp, Homo sapiens
attttaactatttttgtatag

SEQ ID NO: 7536 - DNA, 21 bp, Homo sapiens
ttttaactatttttgtatagt

SEQ ID NO: 7537 - DNA, 21 bp, Homo sapiens
tatttttgtatagtgtaaact

SEQ ID NO: 7538 - DNA, 21 bp, Homo sapiens
atttttgtatagtgtaaactg

SEQ ID NO: 7539 - DNA, 21 bp, Homo sapiens
tttttgtatagtgtaaactga

SEQ ID NO: 7540 - DNA, 21 bp, Homo sapiens
aactgaaacatgcacattttg

SEQ ID NO: 7541 - DNA, 21 bp, Homo sapiens
aacatgcacattttgtacatt

SEQ ID NO: 7542 - DNA, 21 bp, Homo sapiens
tccagttgttttccatcattt

SEQ ID NO: 7543 - DNA, 21 bp, Homo sapiens
cagttgttttccatcatttgg

SEQ ID NO: 7544 - DNA, 21 bp, Homo sapiens
atgttggtcatatcaaacatt

SEQ ID NO: 7545 - DNA, 21 bp, Homo sapiens
tgttggtcatatcaaacatta

SEQ ID NO: 7546 - DNA, 21 bp, Homo sapiens
gttggtcatatcaaacattaa

SEQ ID NO: 7547 - DNA, 21 bp, Homo sapiens
gtcatatcaaacattaaaaat

SEQ ID NO: 7548 - DNA, 21 bp, Homo sapiens
aaaatgaccactcttttaatt

SEQ ID NO: 7549 - DNA, 21 bp, Homo sapiens
aaatgaccactcttttaattg

SEQ ID NO: 7550 - DNA, 21 bp, Homo sapiens
ctcttttaattgaaattaact

SEQ ID NO: 7551 - DNA, 21 bp, Homo sapiens
tcttttaattgaaattaactt

SEQ ID NO: 7552 - DNA, 21 bp, Homo sapiens
ttttaattgaaattaactttt

SEQ ID NO: 7553 - DNA, 21 bp, Homo sapiens
ttaattgaaattaacttttaa

SEQ ID NO: 7554 - DNA, 21 bp, Homo sapiens
taattgaaattaacttttaaa

SEQ ID NO: 7555 - DNA, 21 bp, Homo sapiens
aattgaaattaacttttaaat

SEQ ID NO: 7556 - DNA, 21 bp, Homo sapiens
attgaaattaacttttaaatg

SEQ ID NO: 7557 - DNA, 21 bp, Homo sapiens
ttgaaattaacttttaaatgt

SEQ ID NO: 7558 - DNA, 21 bp, Homo sapiens
tgaaattaacttttaaatgtt

SEQ ID NO: 7559 - DNA, 21 bp, Homo sapiens
aattaacttttaaatgtttat

SEQ ID NO: 7560 - DNA, 21 bp, Homo sapiens
aacttttaaatgtttatagga

SEQ ID NO: 7561 - DNA, 21 bp, Homo sapiens
tttaaatgtttataggagtat

SEQ ID NO: 7562 - DNA, 21 bp, Homo sapiens
ttaaatgtttataggagtatg

SEQ ID NO: 7563 - DNA, 21 bp, Homo sapiens
gctgtgaagtgatctaaaatt

SEQ ID NO: 7564 - DNA, 21 bp, Homo sapiens
tgtgaagtgatctaaaatttg

SEQ ID NO: 7565 - DNA, 21 bp, Homo sapiens
gtgaagtgatctaaaatttgt

SEQ ID NO: 7566 - DNA, 21 bp, Homo sapiens
tgaagtgatctaaaatttgta

SEQ ID NO: 7567 - DNA, 21 bp, Homo sapiens
gaagtgatctaaaatttgtaa

SEQ ID NO: 7568 - DNA, 21 bp, Homo sapiens
aagtgatctaaaatttgtaat

SEQ ID NO: 7569 - DNA, 21 bp, Homo sapiens
agtgatctaaaatttgtaata

SEQ ID NO: 7570 - DNA, 21 bp, Homo sapiens
atctaaaatttgtaatatttt

SEQ ID NO: 7571 - DNA, 21 bp, Homo sapiens
tctaaaatttgtaatattttt

SEQ ID NO: 7572 - DNA, 21 bp, Homo sapiens
aaatttgtaatatttttgtca

SEQ ID NO: 7573 - DNA, 21 bp, Homo sapiens
aatttgtaatatttttgtcat

SEQ ID NO: 7574 - DNA, 21 bp, Homo sapiens
atttgtaatatttttgtcatg

SEQ ID NO: 7575 - DNA, 21 bp, Homo sapiens
gtaatatttttgtcatgaact

SEQ ID NO: 7576 - DNA, 21 bp, Homo sapiens
taatatttttgtcatgaactg

SEQ ID NO: 7577 - DNA, 21 bp, Homo sapiens
aactgtactactcctaattat

SEQ ID NO: 7578 - DNA, 21 bp, Homo sapiens
actgtactactcctaattatt

SEQ ID NO: 7579 - DNA, 21 bp, Homo sapiens
tcctaattattgtaatgtaat

SEQ ID NO: 7580 - DNA, 21 bp, Homo sapiens
cctaattattgtaatgtaata

SEQ ID NO: 7581 - DNA, 21 bp, Homo sapiens
taattattgtaatgtaataaa

SEQ ID NO: 7582 - DNA, 21 bp, Homo sapiens
attattgtaatgtaataaaaa

SEQ ID NO: 7583 - DNA, 21 bp, Homo sapiens
ttattgtaatgtaataaaaat

SEQ ID NO: 7584 - DNA, 21 bp, Homo sapiens
attgtaatgtaataaaaatag

SEQ ID NO: 7585 - DNA, 21 bp, Homo sapiens
ttgtaatgtaataaaaatagt

SEQ ID NO: 7586 - DNA, 21 bp, Homo sapiens
aatgtaataaaaatagttaca

SEQ ID NO: 7587 - DNA, 21 bp, Homo sapiens
atgtaataaaaatagttacag

SEQ ID NO: 7588 - DNA, 21 bp, Homo sapiens
tgtaataaaaatagttacagt

SEQ ID NO: 7589 - DNA, 21 bp, Homo sapiens
aaatagttacagtgacaaaaa

SEQ ID NO: 7590 - DNA, 21 bp, Homo sapiens
aatagttacagtgacaaaaaa

SEQ ID NO: 7591 - DNA, 21 bp, Homo sapiens
tagttacagtgacaaaaaaaa

SEQ ID NO: 7592 - DNA, 21 bp, Homo sapiens
cctgctgaaaatgactgaata

SEQ ID NO: 7593 - DNA, 21 bp, Homo sapiens
gaaaatgactgaatataaact

SEQ ID NO: 7594 - DNA, 21 bp, Homo sapiens
atgactgaatataaacttgtg

SEQ ID NO: 7595 - DNA, 21 bp, Homo sapiens
acagctaattcagaatcattt

SEQ ID NO: 7596 - DNA, 21 bp, Homo sapiens
ggacgaatatgatccaacaat

SEQ ID NO: 7597 - DNA, 21 bp, Homo sapiens
gaagcaagtagtaattgatgg

SEQ ID NO: 7598 - DNA, 21 bp, Homo sapiens
ggggagggctttctttgtgta

SEQ ID NO: 7599 - DNA, 21 bp, Homo sapiens
tttctttgtgtatttgccata

SEQ ID NO: 7600 - DNA, 21 bp, Homo sapiens
ttctttgtgtatttgccataa

SEQ ID NO: 7601 - DNA, 21 bp, Homo sapiens
tctttgtgtatttgccataaa

SEQ ID NO: 7602 - DNA, 21 bp, Homo sapiens
ctttgtgtatttgccataaat

SEQ ID NO: 7603 - DNA, 21 bp, Homo sapiens
gtgtatttgccataaataata

SEQ ID NO: 7604 - DNA, 21 bp, Homo sapiens
tgtatttgccataaataatac

SEQ ID NO: 7605 - DNA, 21 bp, Homo sapiens
tgccataaataatactaaatc

SEQ ID NO: 7606 - DNA, 21 bp, Homo sapiens
gccataaataatactaaatca

SEQ ID NO: 7607 - DNA, 21 bp, Homo sapiens
cataaataatactaaatcatt

SEQ ID NO: 7608 - DNA, 21 bp, Homo sapiens
ataaataatactaaatcattt

SEQ ID NO: 7609 - DNA, 21 bp, Homo sapiens
taaataatactaaatcatttg

SEQ ID NO: 7610 - DNA, 21 bp, Homo sapiens
aaataatactaaatcatttga

SEQ ID NO: 7611 - DNA, 21 bp, Homo sapiens
tcatttgaagatattcaccat

SEQ ID NO: 7612 - DNA, 21 bp, Homo sapiens
atttgaagatattcaccatta

SEQ ID NO: 7613 - DNA, 21 bp, Homo sapiens
tttgaagatattcaccattat

SEQ ID NO: 7614 - DNA, 21 bp, Homo sapiens
ttgaagatattcaccattata

SEQ ID NO: 7615 - DNA, 21 bp, Homo sapiens
tgaagatattcaccattatag

SEQ ID NO: 7616 - DNA, 21 bp, Homo sapiens
caccattatagagaacaaatt

SEQ ID NO: 7617 - DNA, 21 bp, Homo sapiens
ccattatagagaacaaattaa

SEQ ID NO: 7618 - DNA, 21 bp, Homo sapiens
cattatagagaacaaattaaa

SEQ ID NO: 7619 - DNA, 21 bp, Homo sapiens
attatagagaacaaattaaaa

SEQ ID NO: 7620 - DNA, 21 bp, Homo sapiens
ttatagagaacaaattaaaag

SEQ ID NO: 7621 - DNA, 21 bp, Homo sapiens
tcctagtaggaaataaatgtg

SEQ ID NO: 7622 - DNA, 21 bp, Homo sapiens
cctagtaggaaataaatgtga

SEQ ID NO: 7623 - DNA, 21 bp, Homo sapiens
gcaagaagttatggaattcct

SEQ ID NO: 7624 - DNA, 21 bp, Homo sapiens
agaagttatggaattcctttt

SEQ ID NO: 7625 - DNA, 21 bp, Homo sapiens
gaagttatggaattcctttta

SEQ ID NO: 7626 - DNA, 21 bp, Homo sapiens
aagttatggaattccttttat

SEQ ID NO: 7627 - DNA, 21 bp, Homo sapiens
agttatggaattccttttatt

SEQ ID NO: 7628 - DNA, 21 bp, Homo sapiens
agtggaggatgctttttatac

SEQ ID NO: 7629 - DNA, 21 bp, Homo sapiens
tggaggatgctttttatacat

SEQ ID NO: 7630 - DNA, 21 bp, Homo sapiens
atacagattgaaaaaaatcag

SEQ ID NO: 7631 - DNA, 21 bp, Homo sapiens
tacagattgaaaaaaatcagc

SEQ ID NO: 7632 - DNA, 21 bp, Homo sapiens
cagattgaaaaaaatcagcaa

SEQ ID NO: 7633 - DNA, 21 bp, Homo sapiens
agattgaaaaaaatcagcaaa

SEQ ID NO: 7634 - DNA, 21 bp, Homo sapiens
gattgaaaaaaatcagcaaag

SEQ ID NO: 7635 - DNA, 21 bp, Homo sapiens
attgaaaaaaatcagcaaaga

SEQ ID NO: 7636 - DNA, 21 bp, Homo sapiens
actcctggctgtgtgaaaatt

SEQ ID NO: 7637 - DNA, 21 bp, Homo sapiens
ctggctgtgtgaaaattaaaa

SEQ ID NO: 7638 - DNA, 21 bp, Homo sapiens
ctgtgtgaaaattaaaaaatg

SEQ ID NO: 7639 - DNA, 21 bp, Homo sapiens
tgtgtgaaaattaaaaaatgc

SEQ ID NO: 7640 - DNA, 21 bp, Homo sapiens
gtgtgaaaattaaaaaatgca

SEQ ID NO: 7641 - DNA, 21 bp, Homo sapiens
tgtgaaaattaaaaaatgcat

SEQ ID NO: 7642 - DNA, 21 bp, Homo sapiens
tgaaaattaaaaaatgcatta

SEQ ID NO: 7643 - DNA, 21 bp, Homo sapiens
gaaaattaaaaaatgcattat

SEQ ID NO: 7644 - DNA, 21 bp, Homo sapiens
aaaattaaaaaatgcattata

SEQ ID NO: 7645 - DNA, 21 bp, Homo sapiens
aaattaaaaaatgcattataa

SEQ ID NO: 7646 - DNA, 21 bp, Homo sapiens
attaaaaaatgcattataatg

SEQ ID NO: 7647 - DNA, 21 bp, Homo sapiens
aatgcattataatgtaatctg

SEQ ID NO: 7648 - DNA, 21 bp, Homo sapiens
agttcgagaaattcgaaaaca

SEQ ID NO: 7649 - DNA, 21 bp, Homo sapiens
gttcgagaaattcgaaaacat

SEQ ID NO: 7650 - DNA, 21 bp, Homo sapiens
ttcgagaaattcgaaaacata

SEQ ID NO: 7651 - DNA, 21 bp, Homo sapiens
gagaaattcgaaaacataaag

SEQ ID NO: 7652 - DNA, 21 bp, Homo sapiens
attcgaaaacataaagaaaag

SEQ ID NO: 7653 - DNA, 21 bp, Homo sapiens
ttcgaaaacataaagaaaaga

SEQ ID NO: 7654 - DNA, 21 bp, Homo sapiens
gcaaagatggtaaaaagaaga

SEQ ID NO: 7655 - DNA, 21 bp, Homo sapiens
caaagatggtaaaaagaagaa

SEQ ID NO: 7656 - DNA, 21 bp, Homo sapiens
aagatggtaaaaagaagaaaa

SEQ ID NO: 7657 - DNA, 21 bp, Homo sapiens
agatggtaaaaagaagaaaaa

SEQ ID NO: 7658 - DNA, 21 bp, Homo sapiens
gtaaaaagaagaaaaagaagt

SEQ ID NO: 7659 - DNA, 21 bp, Homo sapiens
taaaaagaagaaaaagaagtc

SEQ ID NO: 7660 - DNA, 21 bp, Homo sapiens
aaaaagaagaaaaagaagtca

SEQ ID NO: 7661 - DNA, 21 bp, Homo sapiens
agtcaaagacaaagtgtgtaa

SEQ ID NO: 7662 - DNA, 21 bp, Homo sapiens
gtcaaagacaaagtgtgtaat

SEQ ID NO: 7663 - DNA, 21 bp, Homo sapiens
aagacaaagtgtgtaattatg

SEQ ID NO: 7664 - DNA, 21 bp, Homo sapiens
gacaaagtgtgtaattatgta

SEQ ID NO: 7665 - DNA, 21 bp, Homo sapiens
aagtgtgtaattatgtaaata

SEQ ID NO: 7666 - DNA, 21 bp, Homo sapiens
gtgtgtaattatgtaaataca

SEQ ID NO: 7667 - DNA, 21 bp, Homo sapiens
gtgtaattatgtaaatacaat

SEQ ID NO: 7668 - DNA, 21 bp, Homo sapiens
tgtaattatgtaaatacaatt

SEQ ID NO: 7669 - DNA, 21 bp, Homo sapiens
attatgtaaatacaatttgta

SEQ ID NO: 7670 - DNA, 21 bp, Homo sapiens
ttatgtaaatacaatttgtac

SEQ ID NO: 7671 - DNA, 21 bp, Homo sapiens
tatgtaaatacaatttgtact

SEQ ID NO: 7672 - DNA, 21 bp, Homo sapiens
atgtaaatacaatttgtactt

SEQ ID NO: 7673 - DNA, 21 bp, Homo sapiens
atacaatttgtacttttttct

SEQ ID NO: 7674 - DNA, 21 bp, Homo sapiens
tacaatttgtacttttttctt

SEQ ID NO: 7675 - DNA, 21 bp, Homo sapiens
catactagtacaagtggtaat

SEQ ID NO: 7676 - DNA, 21 bp, Homo sapiens
atactagtacaagtggtaatt

SEQ ID NO: 7677 - DNA, 21 bp, Homo sapiens
gtacaagtggtaatttttgta

SEQ ID NO: 7678 - DNA, 21 bp, Homo sapiens
tacaagtggtaatttttgtac

SEQ ID NO: 7679 - DNA, 21 bp, Homo sapiens
ggtaatttttgtacattacac

SEQ ID NO: 7680 - DNA, 21 bp, Homo sapiens
gtaatttttgtacattacact

SEQ ID NO: 7681 - DNA, 21 bp, Homo sapiens
taatttttgtacattacacta

SEQ ID NO: 7682 - DNA, 21 bp, Homo sapiens
aatttttgtacattacactaa

SEQ ID NO: 7683 - DNA, 21 bp, Homo sapiens
atttttgtacattacactaaa

SEQ ID NO: 7684 - DNA, 21 bp, Homo sapiens
tacactaaattattagcattt

SEQ ID NO: 7685 - DNA, 21 bp, Homo sapiens
cactaaattattagcatttgt

SEQ ID NO: 7686 - DNA, 21 bp, Homo sapiens
actaaattattagcatttgtt

SEQ ID NO: 7687 - DNA, 21 bp, Homo sapiens
attattagcatttgttttagc

SEQ ID NO: 7688 - DNA, 21 bp, Homo sapiens
agcatttgttttagcattacc

SEQ ID NO: 7689 - DNA, 21 bp, Homo sapiens
gcatttgttttagcattacct

SEQ ID NO: 7690 - DNA, 21 bp, Homo sapiens
atttgttttagcattacctaa

SEQ ID NO: 7691 - DNA, 21 bp, Homo sapiens
tttgttttagcattacctaat

SEQ ID NO: 7692 - DNA, 21 bp, Homo sapiens
ttgttttagcattacctaatt

SEQ ID NO: 7693 - DNA, 21 bp, Homo sapiens
tgttttagcattacctaattt

SEQ ID NO: 7694 - DNA, 21 bp, Homo sapiens
cagactgttagcttttacctt

SEQ ID NO: 7695 - DNA, 21 bp, Homo sapiens
agactgttagcttttacctta

SEQ ID NO: 7696 - DNA, 21 bp, Homo sapiens
ttagcttttaccttaaatgct

SEQ ID NO: 7697 - DNA, 21 bp, Homo sapiens
tagcttttaccttaaatgctt

SEQ ID NO: 7698 - DNA, 21 bp, Homo sapiens
agcttttaccttaaatgctta

SEQ ID NO: 7699 - DNA, 21 bp, Homo sapiens
taccttaaatgcttattttaa

SEQ ID NO: 7700 - DNA, 21 bp, Homo sapiens
accttaaatgcttattttaaa

SEQ ID NO: 7701 - DNA, 21 bp, Homo sapiens
aatgcttattttaaaatgaca

SEQ ID NO: 7702 - DNA, 21 bp, Homo sapiens
tgcttattttaaaatgacagt

SEQ ID NO: 7703 - DNA, 21 bp, Homo sapiens
cagtggaagtttttttttcct

SEQ ID NO: 7704 - DNA, 21 bp, Homo sapiens
gtggaagtttttttttcctct

SEQ ID NO: 7705 - DNA, 21 bp, Homo sapiens
tggaagtttttttttcctcta

SEQ ID NO: 7706 - DNA, 21 bp, Homo sapiens
agttttggtttttgaactagc

SEQ ID NO: 7707 - DNA, 21 bp, Homo sapiens
atgcctgtgaaaaagaaactg

SEQ ID NO: 7708 - DNA, 21 bp, Homo sapiens
tgaaaaagaaactgaatacct

SEQ ID NO: 7709 - DNA, 21 bp, Homo sapiens
gaaaaagaaactgaataccta

SEQ ID NO: 7710 - DNA, 21 bp, Homo sapiens
gaaactgaatacctaagattt

SEQ ID NO: 7711 - DNA, 21 bp, Homo sapiens
catgcagttgattacttctta

SEQ ID NO: 7712 - DNA, 21 bp, Homo sapiens
atgcagttgattacttcttat

SEQ ID NO: 7713 - DNA, 21 bp, Homo sapiens
agttgattacttcttattttt

SEQ ID NO: 7714 - DNA, 21 bp, Homo sapiens
acttcttatttttcttaccaa

SEQ ID NO: 7715 - DNA, 21 bp, Homo sapiens
cttcttatttttcttaccaat

SEQ ID NO: 7716 - DNA, 21 bp, Homo sapiens
ttcttatttttcttaccaatt

SEQ ID NO: 7717 - DNA, 21 bp, Homo sapiens
gaatgttggtgtgaaacaaat

SEQ ID NO: 7718 - DNA, 21 bp, Homo sapiens
tgttggtgtgaaacaaattaa

SEQ ID NO: 7719 - DNA, 21 bp, Homo sapiens
gttggtgtgaaacaaattaat

SEQ ID NO: 7720 - DNA, 21 bp, Homo sapiens
gaaacaaattaatgaagcttt

SEQ ID NO: 7721 - DNA, 21 bp, Homo sapiens
aaacaaattaatgaagctttt

SEQ ID NO: 7722 - DNA, 21 bp, Homo sapiens
attctgtgttttatctagtca

SEQ ID NO: 7723 - DNA, 21 bp, Homo sapiens
ttctgtgttttatctagtcac

SEQ ID NO: 7724 - DNA, 21 bp, Homo sapiens
tgtgttttatctagtcacata

SEQ ID NO: 7725 - DNA, 21 bp, Homo sapiens
gtgttttatctagtcacataa

SEQ ID NO: 7726 - DNA, 21 bp, Homo sapiens
ttatctagtcacataaatgga

SEQ ID NO: 7727 - DNA, 21 bp, Homo sapiens
tatctagtcacataaatggat

SEQ ID NO: 7728 - DNA, 21 bp, Homo sapiens
cacataaatggattaattact

SEQ ID NO: 7729 - DNA, 21 bp, Homo sapiens
acataaatggattaattacta

SEQ ID NO: 7730 - DNA, 21 bp, Homo sapiens
aatggattaattactaatttc

SEQ ID NO: 7731 - DNA, 21 bp, Homo sapiens
tggattaattactaatttcag

SEQ ID NO: 7732 - DNA, 21 bp, Homo sapiens
ggattaattactaatttcagt

SEQ ID NO: 7733 - DNA, 21 bp, Homo sapiens
gattaattactaatttcagtt

SEQ ID NO: 7734 - DNA, 21 bp, Homo sapiens
tctaattggtttttactgaaa

SEQ ID NO: 7735 - DNA, 21 bp, Homo sapiens
attggtttttactgaaacatt

SEQ ID NO: 7736 - DNA, 21 bp, Homo sapiens
ttggtttttactgaaacattg

SEQ ID NO: 7737 - DNA, 21 bp, Homo sapiens
acattgagggaacacaaattt

SEQ ID NO: 7738 - DNA, 21 bp, Homo sapiens
cattgagggaacacaaattta

SEQ ID NO: 7739 - DNA, 21 bp, Homo sapiens
cctgatgaatgtaaagttaca

SEQ ID NO: 7740 - DNA, 21 bp, Homo sapiens
ctgatgaatgtaaagttacac

SEQ ID NO: 7741 - DNA, 21 bp, Homo sapiens
ccccaaaatattatatttttt

SEQ ID NO: 7742 - DNA, 21 bp, Homo sapiens
cccaaaatattatattttttc

SEQ ID NO: 7743 - DNA, 21 bp, Homo sapiens
ccaaaatattatattttttct

SEQ ID NO: 7744 - DNA, 21 bp, Homo sapiens
caaaatattatattttttcta

SEQ ID NO: 7745 - DNA, 21 bp, Homo sapiens
aaatattatattttttctata

SEQ ID NO: 7746 - DNA, 21 bp, Homo sapiens
aatattatattttttctataa

SEQ ID NO: 7747 - DNA, 21 bp, Homo sapiens
atattatattttttctataaa

SEQ ID NO: 7748 - DNA, 21 bp, Homo sapiens
tattatattttttctataaaa

SEQ ID NO: 7749 - DNA, 21 bp, Homo sapiens
attatattttttctataaaaa

SEQ ID NO: 7750 - DNA, 21 bp, Homo sapiens
ttatattttttctataaaaag

SEQ ID NO: 7751 - DNA, 21 bp, Homo sapiens
tatattttttctataaaaaga

SEQ ID NO: 7752 - DNA, 21 bp, Homo sapiens
atattttttctataaaaagaa

SEQ ID NO: 7753 - DNA, 21 bp, Homo sapiens
ttttctataaaaagaaaaaaa

SEQ ID NO: 7754 - DNA, 21 bp, Homo sapiens
tttctataaaaagaaaaaaat

SEQ ID NO: 7755 - DNA, 21 bp, Homo sapiens
tctataaaaagaaaaaaatgg

SEQ ID NO: 7756 - DNA, 21 bp, Homo sapiens
ctataaaaagaaaaaaatgga

SEQ ID NO: 7757 - DNA, 21 bp, Homo sapiens
tataaaaagaaaaaaatggaa

SEQ ID NO: 7758 - DNA, 21 bp, Homo sapiens
ataaaaagaaaaaaatggaaa

SEQ ID NO: 7759 - DNA, 21 bp, Homo sapiens
taaaaagaaaaaaatggaaaa

SEQ ID NO: 7760 - DNA, 21 bp, Homo sapiens
aaaaagaaaaaaatggaaaaa

SEQ ID NO: 7761 - DNA, 21 bp, Homo sapiens
aaaagaaaaaaatggaaaaaa

SEQ ID NO: 7762 - DNA, 21 bp, Homo sapiens
gaaaaaaatggaaaaaaatta

SEQ ID NO: 7763 - DNA, 21 bp, Homo sapiens
aaaaaaatggaaaaaaattac

SEQ ID NO: 7764 - DNA, 21 bp, Homo sapiens
aatggaaaaaaattacaaggc

SEQ ID NO: 7765 - DNA, 21 bp, Homo sapiens
atggaaaaaaattacaaggca

SEQ ID NO: 7766 - DNA, 21 bp, Homo sapiens
tggaaaaaaattacaaggcaa

SEQ ID NO: 7767 - DNA, 21 bp, Homo sapiens
aggccatttccttttcacatt

SEQ ID NO: 7768 - DNA, 21 bp, Homo sapiens
tttccttttcacattagataa

SEQ ID NO: 7769 - DNA, 21 bp, Homo sapiens
ttcacattagataaattacta

SEQ ID NO: 7770 - DNA, 21 bp, Homo sapiens
tcacattagataaattactat

SEQ ID NO: 7771 - DNA, 21 bp, Homo sapiens
cacattagataaattactata

SEQ ID NO: 7772 - DNA, 21 bp, Homo sapiens
ccagtatgaaatggggattat

SEQ ID NO: 7773 - DNA, 21 bp, Homo sapiens
aatggggattattatagcaac

SEQ ID NO: 7774 - DNA, 21 bp, Homo sapiens
ggggctatatttacatgctac

SEQ ID NO: 7775 - DNA, 21 bp, Homo sapiens
gggctatatttacatgctact

SEQ ID NO: 7776 - DNA, 21 bp, Homo sapiens
ggctatatttacatgctacta

SEQ ID NO: 7777 - DNA, 21 bp, Homo sapiens
gctatatttacatgctactaa

SEQ ID NO: 7778 - DNA, 21 bp, Homo sapiens
ctatatttacatgctactaaa

SEQ ID NO: 7779 - DNA, 21 bp, Homo sapiens
tttacatgctactaaattttt

SEQ ID NO: 7780 - DNA, 21 bp, Homo sapiens
gctactaaatttttataataa

SEQ ID NO: 7781 - DNA, 21 bp, Homo sapiens
ctactaaatttttataataat

SEQ ID NO: 7782 - DNA, 21 bp, Homo sapiens
actaaatttttataataattg

SEQ ID NO: 7783 - DNA, 21 bp, Homo sapiens
ctaaatttttataataattga

SEQ ID NO: 7784 - DNA, 21 bp, Homo sapiens
taaatttttataataattgaa

SEQ ID NO: 7785 - DNA, 21 bp, Homo sapiens
aaatttttataataattgaaa

SEQ ID NO: 7786 - DNA, 21 bp, Homo sapiens
aatttttataataattgaaaa

SEQ ID NO: 7787 - DNA, 21 bp, Homo sapiens
atttttataataattgaaaag

SEQ ID NO: 7788 - DNA, 21 bp, Homo sapiens
tttttataataattgaaaaga

SEQ ID NO: 7789 - DNA, 21 bp, Homo sapiens
ttttataataattgaaaagat

SEQ ID NO: 7790 - DNA, 21 bp, Homo sapiens
tttataataattgaaaagatt

SEQ ID NO: 7791 - DNA, 21 bp, Homo sapiens
taataattgaaaagattttaa

SEQ ID NO: 7792 - DNA, 21 bp, Homo sapiens
aataattgaaaagattttaac

SEQ ID NO: 7793 - DNA, 21 bp, Homo sapiens
taattgaaaagattttaacaa

SEQ ID NO: 7794 - DNA, 21 bp, Homo sapiens
aattgaaaagattttaacaag

SEQ ID NO: 7795 - DNA, 21 bp, Homo sapiens
attgaaaagattttaacaagt

SEQ ID NO: 7796 - DNA, 21 bp, Homo sapiens
ttgaaaagattttaacaagta

SEQ ID NO: 7797 - DNA, 21 bp, Homo sapiens
tgaaaagattttaacaagtat

SEQ ID NO: 7798 - DNA, 21 bp, Homo sapiens
gaaaagattttaacaagtata

SEQ ID NO: 7799 - DNA, 21 bp, Homo sapiens
aaaagattttaacaagtataa

SEQ ID NO: 7800 - DNA, 21 bp, Homo sapiens
aaagattttaacaagtataaa

SEQ ID NO: 7801 - DNA, 21 bp, Homo sapiens
aagattttaacaagtataaaa

SEQ ID NO: 7802 - DNA, 21 bp, Homo sapiens
taacaagtataaaaaattctc

SEQ ID NO: 7803 - DNA, 21 bp, Homo sapiens
aacaagtataaaaaattctca

SEQ ID NO: 7804 - DNA, 21 bp, Homo sapiens
acaagtataaaaaattctcat

SEQ ID NO: 7805 - DNA, 21 bp, Homo sapiens
caagtataaaaaattctcata

SEQ ID NO: 7806 - DNA, 21 bp, Homo sapiens
aagtataaaaaattctcatag

SEQ ID NO: 7807 - DNA, 21 bp, Homo sapiens
agtataaaaaattctcatagg

SEQ ID NO: 7808 - DNA, 21 bp, Homo sapiens
gtataaaaaattctcatagga

SEQ ID NO: 7809 - DNA, 21 bp, Homo sapiens
tataaaaaattctcataggaa

SEQ ID NO: 7810 - DNA, 21 bp, Homo sapiens
taaaaaattctcataggaatt

SEQ ID NO: 7811 - DNA, 21 bp, Homo sapiens
aaaaaattctcataggaatta

SEQ ID NO: 7812 - DNA, 21 bp, Homo sapiens
tgctctttcatagtataactt

SEQ ID NO: 7813 - DNA, 21 bp, Homo sapiens
tttcatagtataactttaaat

SEQ ID NO: 7814 - DNA, 21 bp, Homo sapiens
ttcatagtataactttaaatc

SEQ ID NO: 7815 - DNA, 21 bp, Homo sapiens
actttaaatcttttcttcaac

SEQ ID NO: 7816 - DNA, 21 bp, Homo sapiens
ctttaaatcttttcttcaact

SEQ ID NO: 7817 - DNA, 21 bp, Homo sapiens
tcaacttgagtctttgaagat

SEQ ID NO: 7818 - DNA, 21 bp, Homo sapiens
aacttgagtctttgaagatag

SEQ ID NO: 7819 - DNA, 21 bp, Homo sapiens
acttgagtctttgaagatagt

SEQ ID NO: 7820 - DNA, 21 bp, Homo sapiens
tgaagatagttttaattctgc

SEQ ID NO: 7821 - DNA, 21 bp, Homo sapiens
gaagatagttttaattctgct

SEQ ID NO: 7822 - DNA, 21 bp, Homo sapiens
aagatagttttaattctgctt

SEQ ID NO: 7823 - DNA, 21 bp, Homo sapiens
tctgcttgtgacattaaaaga

SEQ ID NO: 7824 - DNA, 21 bp, Homo sapiens
agagcattgcttttgtttctt

SEQ ID NO: 7825 - DNA, 21 bp, Homo sapiens
gagcattgcttttgtttctta

SEQ ID NO: 7826 - DNA, 21 bp, Homo sapiens
tgcttttgtttcttaagaaaa

SEQ ID NO: 7827 - DNA, 21 bp, Homo sapiens
gtttcttaagaaaacaaactc

SEQ ID NO: 7828 - DNA, 21 bp, Homo sapiens
tttcttaagaaaacaaactct

SEQ ID NO: 7829 - DNA, 21 bp, Homo sapiens
ttcttaagaaaacaaactctt

SEQ ID NO: 7830 - DNA, 21 bp, Homo sapiens
tcttaagaaaacaaactcttt

SEQ ID NO: 7831 - DNA, 21 bp, Homo sapiens
cttaagaaaacaaactctttt

SEQ ID NO: 7832 - DNA, 21 bp, Homo sapiens
ttaagaaaacaaactcttttt

SEQ ID NO: 7833 - DNA, 21 bp, Homo sapiens
taagaaaacaaactctttttt

SEQ ID NO: 7834 - DNA, 21 bp, Homo sapiens
aaaacaaactcttttttaaaa

SEQ ID NO: 7835 - DNA, 21 bp, Homo sapiens
aactcttttttaaaaattact

SEQ ID NO: 7836 - DNA, 21 bp, Homo sapiens
actcttttttaaaaattactt

SEQ ID NO: 7837 - DNA, 21 bp, Homo sapiens
ctcttttttaaaaattacttt

SEQ ID NO: 7838 - DNA, 21 bp, Homo sapiens
tcttttttaaaaattactttt

SEQ ID NO: 7839 - DNA, 21 bp, Homo sapiens
cttttttaaaaattactttta

SEQ ID NO: 7840 - DNA, 21 bp, Homo sapiens
ttttttaaaaattacttttaa

SEQ ID NO: 7841 - DNA, 21 bp, Homo sapiens
tttttaaaaattacttttaaa

SEQ ID NO: 7842 - DNA, 21 bp, Homo sapiens
ttttaaaaattacttttaaat

SEQ ID NO: 7843 - DNA, 21 bp, Homo sapiens
tttaaaaattacttttaaata

SEQ ID NO: 7844 - DNA, 21 bp, Homo sapiens
attacttttaaatattaactc

SEQ ID NO: 7845 - DNA, 21 bp, Homo sapiens
ttacttttaaatattaactca

SEQ ID NO: 7846 - DNA, 21 bp, Homo sapiens
acttttaaatattaactcaaa

SEQ ID NO: 7847 - DNA, 21 bp, Homo sapiens
ttttaaatattaactcaaaag

SEQ ID NO: 7848 - DNA, 21 bp, Homo sapiens
tttaaatattaactcaaaagt

SEQ ID NO: 7849 - DNA, 21 bp, Homo sapiens
ttaaatattaactcaaaagtt

SEQ ID NO: 7850 - DNA, 21 bp, Homo sapiens
taaatattaactcaaaagttg

SEQ ID NO: 7851 - DNA, 21 bp, Homo sapiens
gtggtgtgccaagacattaat

SEQ ID NO: 7852 - DNA, 21 bp, Homo sapiens
gtgccaagacattaatttttt

SEQ ID NO: 7853 - DNA, 21 bp, Homo sapiens
tgccaagacattaattttttt

SEQ ID NO: 7854 - DNA, 21 bp, Homo sapiens
gacattaattttttttttaaa

SEQ ID NO: 7855 - DNA, 21 bp, Homo sapiens
acattaattttttttttaaac

SEQ ID NO: 7856 - DNA, 21 bp, Homo sapiens
attaattttttttttaaacaa

SEQ ID NO: 7857 - DNA, 21 bp, Homo sapiens
taattttttttttaaacaatg

SEQ ID NO: 7858 - DNA, 21 bp, Homo sapiens
aattttttttttaaacaatga

SEQ ID NO: 7859 - DNA, 21 bp, Homo sapiens
attttttttttaaacaatgaa

SEQ ID NO: 7860 - DNA, 21 bp, Homo sapiens
ttttttttttaaacaatgaag

SEQ ID NO: 7861 - DNA, 21 bp, Homo sapiens
tttttttttaaacaatgaagt

SEQ ID NO: 7862 - DNA, 21 bp, Homo sapiens
tttttttaaacaatgaagtga

SEQ ID NO: 7863 - DNA, 21 bp, Homo sapiens
ttttttaaacaatgaagtgaa

SEQ ID NO: 7864 - DNA, 21 bp, Homo sapiens
tttttaaacaatgaagtgaaa

SEQ ID NO: 7865 - DNA, 21 bp, Homo sapiens
caatgaagtgaaaaagtttta

SEQ ID NO: 7866 - DNA, 21 bp, Homo sapiens
agtgaaaaagttttacaatct

SEQ ID NO: 7867 - DNA, 21 bp, Homo sapiens
gtgaaaaagttttacaatctc

SEQ ID NO: 7868 - DNA, 21 bp, Homo sapiens
tgaaaaagttttacaatctct

SEQ ID NO: 7869 - DNA, 21 bp, Homo sapiens
acactggttaaattaacattg

SEQ ID NO: 7870 - DNA, 21 bp, Homo sapiens
cactggttaaattaacattgc

SEQ ID NO: 7871 - DNA, 21 bp, Homo sapiens
actggttaaattaacattgca

SEQ ID NO: 7872 - DNA, 21 bp, Homo sapiens
taacattgcataaacactttt

SEQ ID NO: 7873 - DNA, 21 bp, Homo sapiens
tttcaagtctgatccatattt

SEQ ID NO: 7874 - DNA, 21 bp, Homo sapiens
gatccatatttaataatgctt

SEQ ID NO: 7875 - DNA, 21 bp, Homo sapiens
atccatatttaataatgcttt

SEQ ID NO: 7876 - DNA, 21 bp, Homo sapiens
tccatatttaataatgcttta

SEQ ID NO: 7877 - DNA, 21 bp, Homo sapiens
ccatatttaataatgctttaa

SEQ ID NO: 7878 - DNA, 21 bp, Homo sapiens
catatttaataatgctttaaa

SEQ ID NO: 7879 - DNA, 21 bp, Homo sapiens
atatttaataatgctttaaaa

SEQ ID NO: 7880 - DNA, 21 bp, Homo sapiens
atttaataatgctttaaaata

SEQ ID NO: 7881 - DNA, 21 bp, Homo sapiens
tttaataatgctttaaaataa

SEQ ID NO: 7882 - DNA, 21 bp, Homo sapiens
ttaataatgctttaaaataaa

SEQ ID NO: 7883 - DNA, 21 bp, Homo sapiens
taataatgctttaaaataaaa

SEQ ID NO: 7884 - DNA, 21 bp, Homo sapiens
gctttaaaataaaaataaaaa

SEQ ID NO: 7885 - DNA, 21 bp, Homo sapiens
aaataaaaataaaaacaatcc

SEQ ID NO: 7886 - DNA, 21 bp, Homo sapiens
aataaaaataaaaacaatcct

SEQ ID NO: 7887 - DNA, 21 bp, Homo sapiens
ataaaaataaaaacaatcctt

SEQ ID NO: 7888 - DNA, 21 bp, Homo sapiens
taaaaataaaaacaatccttt

SEQ ID NO: 7889 - DNA, 21 bp, Homo sapiens
aaaaataaaaacaatcctttt

SEQ ID NO: 7890 - DNA, 21 bp, Homo sapiens
aaaataaaaacaatccttttg

SEQ ID NO: 7891 - DNA, 21 bp, Homo sapiens
aaataaaaacaatccttttga

SEQ ID NO: 7892 - DNA, 21 bp, Homo sapiens
aataaaaacaatccttttgat

SEQ ID NO: 7893 - DNA, 21 bp, Homo sapiens
aaaacaatccttttgataaat

SEQ ID NO: 7894 - DNA, 21 bp, Homo sapiens
aatccttttgataaatttaaa

SEQ ID NO: 7895 - DNA, 21 bp, Homo sapiens
atccttttgataaatttaaaa

SEQ ID NO: 7896 - DNA, 21 bp, Homo sapiens
tccttttgataaatttaaaat

SEQ ID NO: 7897 - DNA, 21 bp, Homo sapiens
tttgataaatttaaaatgtta

SEQ ID NO: 7898 - DNA, 21 bp, Homo sapiens
ttgataaatttaaaatgttac

SEQ ID NO: 7899 - DNA, 21 bp, Homo sapiens
tgataaatttaaaatgttact

SEQ ID NO: 7900 - DNA, 21 bp, Homo sapiens
gataaatttaaaatgttactt

SEQ ID NO: 7901 - DNA, 21 bp, Homo sapiens
ataaatttaaaatgttactta

SEQ ID NO: 7902 - DNA, 21 bp, Homo sapiens
taaatttaaaatgttacttat

SEQ ID NO: 7903 - DNA, 21 bp, Homo sapiens
aatttaaaatgttacttattt

SEQ ID NO: 7904 - DNA, 21 bp, Homo sapiens
atttaaaatgttacttatttt

SEQ ID NO: 7905 - DNA, 21 bp, Homo sapiens
tttaaaatgttacttatttta

SEQ ID NO: 7906 - DNA, 21 bp, Homo sapiens
ttaaaatgttacttattttaa

SEQ ID NO: 7907 - DNA, 21 bp, Homo sapiens
taaaatgttacttattttaaa

SEQ ID NO: 7908 - DNA, 21 bp, Homo sapiens
aaatgttacttattttaaaat

SEQ ID NO: 7909 - DNA, 21 bp, Homo sapiens
ttacttattttaaaataaatg

SEQ ID NO: 7910 - DNA, 21 bp, Homo sapiens
acttattttaaaataaatgaa

SEQ ID NO: 7911 - DNA, 21 bp, Homo sapiens
cttattttaaaataaatgaag

SEQ ID NO: 7912 - DNA, 21 bp, Homo sapiens
attttaaaataaatgaagtga

SEQ ID NO: 7913 - DNA, 21 bp, Homo sapiens
ttttaaaataaatgaagtgag

SEQ ID NO: 7914 - DNA, 21 bp, Homo sapiens
tatccatttcttcatgttaaa

SEQ ID NO: 7915 - DNA, 21 bp, Homo sapiens
atccatttcttcatgttaaaa

SEQ ID NO: 7916 - DNA, 21 bp, Homo sapiens
atctcaaactcttagtttttt

SEQ ID NO: 7917 - DNA, 21 bp, Homo sapiens
cttagttttttttttttacaa

SEQ ID NO: 7918 - DNA, 21 bp, Homo sapiens
ttagttttttttttttacaac

SEQ ID NO: 7919 - DNA, 21 bp, Homo sapiens
tagttttttttttttacaact

SEQ ID NO: 7920 - DNA, 21 bp, Homo sapiens
agttttttttttttacaacta

SEQ ID NO: 7921 - DNA, 21 bp, Homo sapiens
gttttttttttttacaactat

SEQ ID NO: 7922 - DNA, 21 bp, Homo sapiens
ttttttttttttacaactatg

SEQ ID NO: 7923 - DNA, 21 bp, Homo sapiens
tttttttttttacaactatgt

SEQ ID NO: 7924 - DNA, 21 bp, Homo sapiens
ttttttttttacaactatgta

SEQ ID NO: 7925 - DNA, 21 bp, Homo sapiens
tttttttttacaactatgtaa

SEQ ID NO: 7926 - DNA, 21 bp, Homo sapiens
ttttttttacaactatgtaat

SEQ ID NO: 7927 - DNA, 21 bp, Homo sapiens
tttttttacaactatgtaatt

SEQ ID NO: 7928 - DNA, 21 bp, Homo sapiens
acaactatgtaatttatattc

SEQ ID NO: 7929 - DNA, 21 bp, Homo sapiens
caactatgtaatttatattcc

SEQ ID NO: 7930 - DNA, 21 bp, Homo sapiens
aactatgtaatttatattcca

SEQ ID NO: 7931 - DNA, 21 bp, Homo sapiens
gtaatttatattccatttaca

SEQ ID NO: 7932 - DNA, 21 bp, Homo sapiens
taatttatattccatttacat

SEQ ID NO: 7933 - DNA, 21 bp, Homo sapiens
aatttatattccatttacata

SEQ ID NO: 7934 - DNA, 21 bp, Homo sapiens
atttatattccatttacataa

SEQ ID NO: 7935 - DNA, 21 bp, Homo sapiens
tttacataaggatacacttat

SEQ ID NO: 7936 - DNA, 21 bp, Homo sapiens
cataaggatacacttatttgt

SEQ ID NO: 7937 - DNA, 21 bp, Homo sapiens
caatctgtaaatttttaacct

SEQ ID NO: 7938 - DNA, 21 bp, Homo sapiens
aatctgtaaatttttaaccta

SEQ ID NO: 7939 - DNA, 21 bp, Homo sapiens
atctgtaaatttttaacctat

SEQ ID NO: 7940 - DNA, 21 bp, Homo sapiens
tgtgcaagaggtgaagtttat

SEQ ID NO: 7941 - DNA, 21 bp, Homo sapiens
tgcaagaggtgaagtttatat

SEQ ID NO: 7942 - DNA, 21 bp, Homo sapiens
gcaagaggtgaagtttatatt

SEQ ID NO: 7943 - DNA, 21 bp, Homo sapiens
aagaggtgaagtttatatttg

SEQ ID NO: 7944 - DNA, 21 bp, Homo sapiens
agaggtgaagtttatatttga

SEQ ID NO: 7945 - DNA, 21 bp, Homo sapiens
tgaagtttatatttgaatatc

SEQ ID NO: 7946 - DNA, 21 bp, Homo sapiens
tgacttgatgcagttttaata

SEQ ID NO: 7947 - DNA, 21 bp, Homo sapiens
acttgatgcagttttaatact

SEQ ID NO: 7948 - DNA, 21 bp, Homo sapiens
gggatttgacctaatcactaa

SEQ ID NO: 7949 - DNA, 21 bp, Homo sapiens
tgacctaatcactaattttca

SEQ ID NO: 7950 - DNA, 21 bp, Homo sapiens
gacagtaggatttttcaaacc

SEQ ID NO: 7951 - DNA, 21 bp, Homo sapiens
ccagtggaaggagaatttaat

SEQ ID NO: 7952 - DNA, 21 bp, Homo sapiens
gtggaaggagaatttaataaa

SEQ ID NO: 7953 - DNA, 21 bp, Homo sapiens
ggaaggagaatttaataaaga

SEQ ID NO: 7954 - DNA, 21 bp, Homo sapiens
gaaggagaatttaataaagat

SEQ ID NO: 7955 - DNA, 21 bp, Homo sapiens
gagaatttaataaagatagtg

SEQ ID NO: 7956 - DNA, 21 bp, Homo sapiens
attccttaggtaatctataac

SEQ ID NO: 7957 - DNA, 21 bp, Homo sapiens
ttccttaggtaatctataact

SEQ ID NO: 7958 - DNA, 21 bp, Homo sapiens
gtaacagtaatacattccatt

SEQ ID NO: 7959 - DNA, 21 bp, Homo sapiens
aacagtaatacattccattgt

SEQ ID NO: 7960 - DNA, 21 bp, Homo sapiens
acagtaatacattccattgtt

SEQ ID NO: 7961 - DNA, 21 bp, Homo sapiens
cagtaatacattccattgttt

SEQ ID NO: 7962 - DNA, 21 bp, Homo sapiens
ttccattgttttagtaaccag

SEQ ID NO: 7963 - DNA, 21 bp, Homo sapiens
taaccagaaatcttcatgcaa

SEQ ID NO: 7964 - DNA, 21 bp, Homo sapiens
tcttcatgcaatgaaaaatac

SEQ ID NO: 7965 - DNA, 21 bp, Homo sapiens
gcaatgaaaaatactttaatt

SEQ ID NO: 7966 - DNA, 21 bp, Homo sapiens
aatgaaaaatactttaattca

SEQ ID NO: 7967 - DNA, 21 bp, Homo sapiens
atgaaaaatactttaattcat

SEQ ID NO: 7968 - DNA, 21 bp, Homo sapiens
aattcatgaagcttacttttt

SEQ ID NO: 7969 - DNA, 21 bp, Homo sapiens
tcatgaagcttactttttttt

SEQ ID NO: 7970 - DNA, 21 bp, Homo sapiens
gaagcttactttttttttttg

SEQ ID NO: 7971 - DNA, 21 bp, Homo sapiens
cttactttttttttttggtgt

SEQ ID NO: 7972 - DNA, 21 bp, Homo sapiens
ttactttttttttttggtgtc

SEQ ID NO: 7973 - DNA, 21 bp, Homo sapiens
tcaactaatttttgtattttt

SEQ ID NO: 7974 - DNA, 21 bp, Homo sapiens
actaatttttgtatttttagg

SEQ ID NO: 7975 - DNA, 21 bp, Homo sapiens
aactcatttattcagcaaata

SEQ ID NO: 7976 - DNA, 21 bp, Homo sapiens
ctcatttattcagcaaatatt

SEQ ID NO: 7977 - DNA, 21 bp, Homo sapiens
catttattcagcaaatattta

SEQ ID NO: 7978 - DNA, 21 bp, Homo sapiens
cgtattttagttttgcaaaga

SEQ ID NO: 7979 - DNA, 21 bp, Homo sapiens
agctctataattgttttgcta

SEQ ID NO: 7980 - DNA, 21 bp, Homo sapiens
gctactttatgtaaatcactt

SEQ ID NO: 7981 - DNA, 21 bp, Homo sapiens
ctactttatgtaaatcacttc

SEQ ID NO: 7982 - DNA, 21 bp, Homo sapiens
tactttatgtaaatcacttca

SEQ ID NO: 7983 - DNA, 21 bp, Homo sapiens
actttatgtaaatcacttcat

SEQ ID NO: 7984 - DNA, 21 bp, Homo sapiens
ctttatgtaaatcacttcatt

SEQ ID NO: 7985 - DNA, 21 bp, Homo sapiens
tttatgtaaatcacttcattg

SEQ ID NO: 7986 - DNA, 21 bp, Homo sapiens
ttatgtaaatcacttcattgt

SEQ ID NO: 7987 - DNA, 21 bp, Homo sapiens
tcattgttttaaaggaataaa

SEQ ID NO: 7988 - DNA, 21 bp, Homo sapiens
cattgttttaaaggaataaac

SEQ ID NO: 7989 - DNA, 21 bp, Homo sapiens
tgttttaaaggaataaacttg

SEQ ID NO: 7990 - DNA, 21 bp, Homo sapiens
gttttaaaggaataaacttga

SEQ ID NO: 7991 - DNA, 21 bp, Homo sapiens
ttttaaaggaataaacttgat

SEQ ID NO: 7992 - DNA, 21 bp, Homo sapiens
ttaaaggaataaacttgatta

SEQ ID NO: 7993 - DNA, 21 bp, Homo sapiens
taaaggaataaacttgattat

SEQ ID NO: 7994 - DNA, 21 bp, Homo sapiens
aaaggaataaacttgattata

SEQ ID NO: 7995 - DNA, 21 bp, Homo sapiens
aaggaataaacttgattatat

SEQ ID NO: 7996 - DNA, 21 bp, Homo sapiens
aggaataaacttgattatatt

SEQ ID NO: 7997 - DNA, 21 bp, Homo sapiens
taaacttgattatattgtttt

SEQ ID NO: 7998 - DNA, 21 bp, Homo sapiens
aaacttgattatattgttttt

SEQ ID NO: 7999 - DNA, 21 bp, Homo sapiens
cttgattatattgttttttta

SEQ ID NO: 8000 - DNA, 21 bp, Homo sapiens
ttatattgtttttttatttgg

SEQ ID NO: 8001 - DNA, 21 bp, Homo sapiens
tatattgtttttttatttggc

SEQ ID NO: 8002 - DNA, 21 bp, Homo sapiens
ttgtttttttatttggcataa

SEQ ID NO: 8003 - DNA, 21 bp, Homo sapiens
tgtttttttatttggcataac

SEQ ID NO: 8004 - DNA, 21 bp, Homo sapiens
tggcataactgtgattctttt

SEQ ID NO: 8005 - DNA, 21 bp, Homo sapiens
taactgtgattcttttaggac

SEQ ID NO: 8006 - DNA, 21 bp, Homo sapiens
aactgtgattcttttaggaca

SEQ ID NO: 8007 - DNA, 21 bp, Homo sapiens
aaggtgtatgtcagatattca

SEQ ID NO: 8008 - DNA, 21 bp, Homo sapiens
aggtgtatgtcagatattcat

SEQ ID NO: 8009 - DNA, 21 bp, Homo sapiens
cccaaatgtgtaatattccag

SEQ ID NO: 8010 - DNA, 21 bp, Homo sapiens
tgcataagtaattaaaatata

SEQ ID NO: 8011 - DNA, 21 bp, Homo sapiens
gcataagtaattaaaatatac

SEQ ID NO: 8012 - DNA, 21 bp, Homo sapiens
cataagtaattaaaatatact

SEQ ID NO: 8013 - DNA, 21 bp, Homo sapiens
ataagtaattaaaatatactt

SEQ ID NO: 8014 - DNA, 21 bp, Homo sapiens
taagtaattaaaatatactta

SEQ ID NO: 8015 - DNA, 21 bp, Homo sapiens
aagtaattaaaatatacttaa

SEQ ID NO: 8016 - DNA, 21 bp, Homo sapiens
agtaattaaaatatacttaaa

SEQ ID NO: 8017 - DNA, 21 bp, Homo sapiens
gtaattaaaatatacttaaaa

SEQ ID NO: 8018 - DNA, 21 bp, Homo sapiens
taattaaaatatacttaaaaa

SEQ ID NO: 8019 - DNA, 21 bp, Homo sapiens
attaaaatatacttaaaaatt

SEQ ID NO: 8020 - DNA, 21 bp, Homo sapiens
ttaaaatatacttaaaaatta

SEQ ID NO: 8021 - DNA, 21 bp, Homo sapiens
taaaatatacttaaaaattaa

SEQ ID NO: 8022 - DNA, 21 bp, Homo sapiens
aaaatatacttaaaaattaat

SEQ ID NO: 8023 - DNA, 21 bp, Homo sapiens
tatacttaaaaattaatagtt

SEQ ID NO: 8024 - DNA, 21 bp, Homo sapiens
cttaaaaattaatagttttat

SEQ ID NO: 8025 - DNA, 21 bp, Homo sapiens
ttaaaaattaatagttttatc

SEQ ID NO: 8026 - DNA, 21 bp, Homo sapiens
taaaaattaatagttttatct

SEQ ID NO: 8027 - DNA, 21 bp, Homo sapiens
ttatctgggtacaaataaaca

SEQ ID NO: 8028 - DNA, 21 bp, Homo sapiens
cagacaaggaaacttctatgt

SEQ ID NO: 8029 - DNA, 21 bp, Homo sapiens
agacaaggaaacttctatgta

SEQ ID NO: 8030 - DNA, 21 bp, Homo sapiens
gacaaggaaacttctatgtaa

SEQ ID NO: 8031 - DNA, 21 bp, Homo sapiens
acttctatgtaaaaatcacta

SEQ ID NO: 8032 - DNA, 21 bp, Homo sapiens
cttctatgtaaaaatcactat

SEQ ID NO: 8033 - DNA, 21 bp, Homo sapiens
ttctatgtaaaaatcactatg

SEQ ID NO: 8034 - DNA, 21 bp, Homo sapiens
atgtaaaaatcactatgattt

SEQ ID NO: 8035 - DNA, 21 bp, Homo sapiens
tgtaaaaatcactatgatttc

SEQ ID NO: 8036 - DNA, 21 bp, Homo sapiens
cactatgatttctgaattgct

SEQ ID NO: 8037 - DNA, 21 bp, Homo sapiens
actatgatttctgaattgcta

SEQ ID NO: 8038 - DNA, 21 bp, Homo sapiens
gctatgtgaaactacagatct

SEQ ID NO: 8039 - DNA, 21 bp, Homo sapiens
ctatgtgaaactacagatctt

SEQ ID NO: 8040 - DNA, 21 bp, Homo sapiens
gtagggtgttaagacttacac

SEQ ID NO: 8041 - DNA, 21 bp, Homo sapiens
tatttaggcctcttgaatttt

SEQ ID NO: 8042 - DNA, 21 bp, Homo sapiens
cctcttgaatttttgatgtag

SEQ ID NO: 8043 - DNA, 21 bp, Homo sapiens
ctcttgaatttttgatgtaga

SEQ ID NO: 8044 - DNA, 21 bp, Homo sapiens
tgtagatgggcatttttttaa

SEQ ID NO: 8045 - DNA, 21 bp, Homo sapiens
tgggcatttttttaaggtagt

SEQ ID NO: 8046 - DNA, 21 bp, Homo sapiens
taaggtagtggttaattacct

SEQ ID NO: 8047 - DNA, 21 bp, Homo sapiens
aggtagtggttaattaccttt

SEQ ID NO: 8048 - DNA, 21 bp, Homo sapiens
ggtagtggttaattaccttta

SEQ ID NO: 8049 - DNA, 21 bp, Homo sapiens
gtagtggttaattacctttat

SEQ ID NO: 8050 - DNA, 21 bp, Homo sapiens
tagtggttaattacctttatg

SEQ ID NO: 8051 - DNA, 21 bp, Homo sapiens
ttacctttatgtgaactttga

SEQ ID NO: 8052 - DNA, 21 bp, Homo sapiens
tttatgtgaactttgaatggt

SEQ ID NO: 8053 - DNA, 21 bp, Homo sapiens
tgaactttgaatggtttaaca

SEQ ID NO: 8054 - DNA, 21 bp, Homo sapiens
ctttgaatggtttaacaaaag

SEQ ID NO: 8055 - DNA, 21 bp, Homo sapiens
tttgaatggtttaacaaaaga

SEQ ID NO: 8056 - DNA, 21 bp, Homo sapiens
ttgaatggtttaacaaaagat

SEQ ID NO: 8057 - DNA, 21 bp, Homo sapiens
tgaatggtttaacaaaagatt

SEQ ID NO: 8058 - DNA, 21 bp, Homo sapiens
gaatggtttaacaaaagattt

SEQ ID NO: 8059 - DNA, 21 bp, Homo sapiens
atggtttaacaaaagatttgt

SEQ ID NO: 8060 - DNA, 21 bp, Homo sapiens
tggtttaacaaaagatttgtt

SEQ ID NO: 8061 - DNA, 21 bp, Homo sapiens
ttaacaaaagatttgtttttg

SEQ ID NO: 8062 - DNA, 21 bp, Homo sapiens
taacaaaagatttgtttttgt

SEQ ID NO: 8063 - DNA, 21 bp, Homo sapiens
aacaaaagatttgtttttgta

SEQ ID NO: 8064 - DNA, 21 bp, Homo sapiens
caaaagatttgtttttgtaga

SEQ ID NO: 8065 - DNA, 21 bp, Homo sapiens
aaaagatttgtttttgtagag

SEQ ID NO: 8066 - DNA, 21 bp, Homo sapiens
aaagatttgtttttgtagaga

SEQ ID NO: 8067 - DNA, 21 bp, Homo sapiens
aagatttgtttttgtagagat

SEQ ID NO: 8068 - DNA, 21 bp, Homo sapiens
tgtttttgtagagattttaaa

SEQ ID NO: 8069 - DNA, 21 bp, Homo sapiens
taaagggggagaattctagaa

SEQ ID NO: 8070 - DNA, 21 bp, Homo sapiens
aagggggagaattctagaaat

SEQ ID NO: 8071 - DNA, 21 bp, Homo sapiens
agggggagaattctagaaata

SEQ ID NO: 8072 - DNA, 21 bp, Homo sapiens
gggggagaattctagaaataa

SEQ ID NO: 8073 - DNA, 21 bp, Homo sapiens
ggggagaattctagaaataaa

SEQ ID NO: 8074 - DNA, 21 bp, Homo sapiens
gggagaattctagaaataaat

SEQ ID NO: 8075 - DNA, 21 bp, Homo sapiens
aattctagaaataaatgttac

SEQ ID NO: 8076 - DNA, 21 bp, Homo sapiens
attctagaaataaatgttacc

SEQ ID NO: 8077 - DNA, 21 bp, Homo sapiens
ttctagaaataaatgttacct

SEQ ID NO: 8078 - DNA, 21 bp, Homo sapiens
tctagaaataaatgttaccta

SEQ ID NO: 8079 - DNA, 21 bp, Homo sapiens
ctagaaataaatgttacctaa

SEQ ID NO: 8080 - DNA, 21 bp, Homo sapiens
agaaataaatgttacctaatt

SEQ ID NO: 8081 - DNA, 21 bp, Homo sapiens
ttacctaattattacagcctt

SEQ ID NO: 8082 - DNA, 21 bp, Homo sapiens
tacctaattattacagcctta

SEQ ID NO: 8083 - DNA, 21 bp, Homo sapiens
agccttaaagacaaaaatcct

SEQ ID NO: 8084 - DNA, 21 bp, Homo sapiens
cttaaagacaaaaatccttgt

SEQ ID NO: 8085 - DNA, 21 bp, Homo sapiens
aatccttgttgaagttttttt

SEQ ID NO: 8086 - DNA, 21 bp, Homo sapiens
atccttgttgaagttttttta

SEQ ID NO: 8087 - DNA, 21 bp, Homo sapiens
ccttgttgaagtttttttaaa

SEQ ID NO: 8088 - DNA, 21 bp, Homo sapiens
cttgttgaagtttttttaaaa

SEQ ID NO: 8089 - DNA, 21 bp, Homo sapiens
ttgaagtttttttaaaaaaag

SEQ ID NO: 8090 - DNA, 21 bp, Homo sapiens
tgaagtttttttaaaaaaagc

SEQ ID NO: 8091 - DNA, 21 bp, Homo sapiens
gaagtttttttaaaaaaagct

SEQ ID NO: 8092 - DNA, 21 bp, Homo sapiens
aagtttttttaaaaaaagcta

SEQ ID NO: 8093 - DNA, 21 bp, Homo sapiens
agtttttttaaaaaaagctaa

SEQ ID NO: 8094 - DNA, 21 bp, Homo sapiens
tttttaaaaaaagctaaatta

SEQ ID NO: 8095 - DNA, 21 bp, Homo sapiens
tttaaaaaaagctaaattaca

SEQ ID NO: 8096 - DNA, 21 bp, Homo sapiens
agacttaggcattaacatgtt

SEQ ID NO: 8097 - DNA, 21 bp, Homo sapiens
gacttaggcattaacatgttt

SEQ ID NO: 8098 - DNA, 21 bp, Homo sapiens
atagcagacgtatattgtatc

SEQ ID NO: 8099 - DNA, 21 bp, Homo sapiens
cagacgtatattgtatcattt

SEQ ID NO: 8100 - DNA, 21 bp, Homo sapiens
gacgtatattgtatcatttga

SEQ ID NO: 8101 - DNA, 21 bp, Homo sapiens
gtatattgtatcatttgagtg

SEQ ID NO: 8102 - DNA, 21 bp, Homo sapiens
tatattgtatcatttgagtga

SEQ ID NO: 8103 - DNA, 21 bp, Homo sapiens
atattgtatcatttgagtgaa

SEQ ID NO: 8104 - DNA, 21 bp, Homo sapiens
gcataggaatttagaacctaa

SEQ ID NO: 8105 - DNA, 21 bp, Homo sapiens
cataggaatttagaacctaac

SEQ ID NO: 8106 - DNA, 21 bp, Homo sapiens
ggaatttagaacctaactttt

SEQ ID NO: 8107 - DNA, 21 bp, Homo sapiens
gaatttagaacctaactttta

SEQ ID NO: 8108 - DNA, 21 bp, Homo sapiens
aatttagaacctaacttttat

SEQ ID NO: 8109 - DNA, 21 bp, Homo sapiens
atttagaacctaacttttata

SEQ ID NO: 8110 - DNA, 21 bp, Homo sapiens
acttttataggttatcaaaac

SEQ ID NO: 8111 - DNA, 21 bp, Homo sapiens
ttttataggttatcaaaactg

SEQ ID NO: 8112 - DNA, 21 bp, Homo sapiens
acaattttgtcctaatatata

SEQ ID NO: 8113 - DNA, 21 bp, Homo sapiens
caattttgtcctaatatatac

SEQ ID NO: 8114 - DNA, 21 bp, Homo sapiens
aattttgtcctaatatataca

SEQ ID NO: 8115 - DNA, 21 bp, Homo sapiens
gtcctaatatatacatagaaa

SEQ ID NO: 8116 - DNA, 21 bp, Homo sapiens
aatatatacatagaaactttg

SEQ ID NO: 8117 - DNA, 21 bp, Homo sapiens
tgcacaagttcatctcatttg

SEQ ID NO: 8118 - DNA, 21 bp, Homo sapiens
atctcatttgtattccattga

SEQ ID NO: 8119 - DNA, 21 bp, Homo sapiens
tctcatttgtattccattgat

SEQ ID NO: 8120 - DNA, 21 bp, Homo sapiens
ctcatttgtattccattgatt

SEQ ID NO: 8121 - DNA, 21 bp, Homo sapiens
tcatttgtattccattgattt

SEQ ID NO: 8122 - DNA, 21 bp, Homo sapiens
catttgtattccattgatttt

SEQ ID NO: 8123 - DNA, 21 bp, Homo sapiens
atttgtattccattgattttt

SEQ ID NO: 8124 - DNA, 21 bp, Homo sapiens
tttgtattccattgatttttt

SEQ ID NO: 8125 - DNA, 21 bp, Homo sapiens
tccattgattttttttttctt

SEQ ID NO: 8126 - DNA, 21 bp, Homo sapiens
ccattgattttttttttcttc

SEQ ID NO: 8127 - DNA, 21 bp, Homo sapiens
tgattttttttttcttctaaa

SEQ ID NO: 8128 - DNA, 21 bp, Homo sapiens
gattttttttttcttctaaac

SEQ ID NO: 8129 - DNA, 21 bp, Homo sapiens
attttttttttcttctaaaca

SEQ ID NO: 8130 - DNA, 21 bp, Homo sapiens
ttttttttttcttctaaacat

SEQ ID NO: 8131 - DNA, 21 bp, Homo sapiens
tttttttttcttctaaacatt

SEQ ID NO: 8132 - DNA, 21 bp, Homo sapiens
taaacattttttcttcaaaca

SEQ ID NO: 8133 - DNA, 21 bp, Homo sapiens
aaacattttttcttcaaacag

SEQ ID NO: 8134 - DNA, 21 bp, Homo sapiens
aacattttttcttcaaacagt

SEQ ID NO: 8135 - DNA, 21 bp, Homo sapiens
acattttttcttcaaacagta

SEQ ID NO: 8136 - DNA, 21 bp, Homo sapiens
cattttttcttcaaacagtat

SEQ ID NO: 8137 - DNA, 21 bp, Homo sapiens
tcttcaaacagtatataactt

SEQ ID NO: 8138 - DNA, 21 bp, Homo sapiens
aaacagtatataacttttttt

SEQ ID NO: 8139 - DNA, 21 bp, Homo sapiens
aacagtatataacttttttta

SEQ ID NO: 8140 - DNA, 21 bp, Homo sapiens
acagtatataactttttttag

SEQ ID NO: 8141 - DNA, 21 bp, Homo sapiens
cagtatataactttttttagg

SEQ ID NO: 8142 - DNA, 21 bp, Homo sapiens
ataactttttttaggggattt

SEQ ID NO: 8143 - DNA, 21 bp, Homo sapiens
taactttttttaggggatttt

SEQ ID NO: 8144 - DNA, 21 bp, Homo sapiens
aggggatttttttttagacag

SEQ ID NO: 8145 - DNA, 21 bp, Homo sapiens
ggggatttttttttagacagc

SEQ ID NO: 8146 - DNA, 21 bp, Homo sapiens
gggatttttttttagacagca

SEQ ID NO: 8147 - DNA, 21 bp, Homo sapiens
tctgaagatttccatttgtca

SEQ ID NO: 8148 - DNA, 21 bp, Homo sapiens
ctgaagatttccatttgtcaa

SEQ ID NO: 8149 - DNA, 21 bp, Homo sapiens
tgaagatttccatttgtcaaa

SEQ ID NO: 8150 - DNA, 21 bp, Homo sapiens
gaagatttccatttgtcaaaa

SEQ ID NO: 8151 - DNA, 21 bp, Homo sapiens
tttccatttgtcaaaaagtaa

SEQ ID NO: 8152 - DNA, 21 bp, Homo sapiens
ttccatttgtcaaaaagtaat

SEQ ID NO: 8153 - DNA, 21 bp, Homo sapiens
tccatttgtcaaaaagtaatg

SEQ ID NO: 8154 - DNA, 21 bp, Homo sapiens
ttgtcaaaaagtaatgatttc

SEQ ID NO: 8155 - DNA, 21 bp, Homo sapiens
tgtcaaaaagtaatgatttct

SEQ ID NO: 8156 - DNA, 21 bp, Homo sapiens
gtcaaaaagtaatgatttctt

SEQ ID NO: 8157 - DNA, 21 bp, Homo sapiens
tcaaaaagtaatgatttcttg

SEQ ID NO: 8158 - DNA, 21 bp, Homo sapiens
aaaaagtaatgatttcttgat

SEQ ID NO: 8159 - DNA, 21 bp, Homo sapiens
aaagtaatgatttcttgataa

SEQ ID NO: 8160 - DNA, 21 bp, Homo sapiens
aagtaatgatttcttgataat

SEQ ID NO: 8161 - DNA, 21 bp, Homo sapiens
gtaatgatttcttgataattg

SEQ ID NO: 8162 - DNA, 21 bp, Homo sapiens
taatgatttcttgataattgt

SEQ ID NO: 8163 - DNA, 21 bp, Homo sapiens
atttcttgataattgtgtagt

SEQ ID NO: 8164 - DNA, 21 bp, Homo sapiens
tttcttgataattgtgtagta

SEQ ID NO: 8165 - DNA, 21 bp, Homo sapiens
ttcttgataattgtgtagtaa

SEQ ID NO: 8166 - DNA, 21 bp, Homo sapiens
cttgataattgtgtagtaatg

SEQ ID NO: 8167 - DNA, 21 bp, Homo sapiens
gataattgtgtagtaatgttt

SEQ ID NO: 8168 - DNA, 21 bp, Homo sapiens
taattgtgtagtaatgttttt

SEQ ID NO: 8169 - DNA, 21 bp, Homo sapiens
aattgtgtagtaatgtttttt

SEQ ID NO: 8170 - DNA, 21 bp, Homo sapiens
taccttaaagctgaatttata

SEQ ID NO: 8171 - DNA, 21 bp, Homo sapiens
ccttaaagctgaatttatatt

SEQ ID NO: 8172 - DNA, 21 bp, Homo sapiens
tgaatttatatttagtaactt

SEQ ID NO: 8173 - DNA, 21 bp, Homo sapiens
gaatttatatttagtaacttc

SEQ ID NO: 8174 - DNA, 21 bp, Homo sapiens
aatttatatttagtaacttct

SEQ ID NO: 8175 - DNA, 21 bp, Homo sapiens
atatttagtaacttctgtgtt

SEQ ID NO: 8176 - DNA, 21 bp, Homo sapiens
aaactgaatagctgtcataaa

SEQ ID NO: 8177 - DNA, 21 bp, Homo sapiens
aactgaatagctgtcataaaa

SEQ ID NO: 8178 - DNA, 21 bp, Homo sapiens
cataaaatgaaactttctttc

SEQ ID NO: 8179 - DNA, 21 bp, Homo sapiens
ataaaatgaaactttctttct

SEQ ID NO: 8180 - DNA, 21 bp, Homo sapiens
taaaatgaaactttctttcta

SEQ ID NO: 8181 - DNA, 21 bp, Homo sapiens
aaatgaaactttctttctaaa

SEQ ID NO: 8182 - DNA, 21 bp, Homo sapiens
gaaactttctttctaaagaaa

SEQ ID NO: 8183 - DNA, 21 bp, Homo sapiens
ctcacatgagttcttgaagaa

SEQ ID NO: 8184 - DNA, 21 bp, Homo sapiens
gttcttgaagaatagtcataa

SEQ ID NO: 8185 - DNA, 21 bp, Homo sapiens
ttcttgaagaatagtcataac

SEQ ID NO: 8186 - DNA, 21 bp, Homo sapiens
tcttgaagaatagtcataact

SEQ ID NO: 8187 - DNA, 21 bp, Homo sapiens
tgaagaatagtcataactaga

SEQ ID NO: 8188 - DNA, 21 bp, Homo sapiens
gaagaatagtcataactagat

SEQ ID NO: 8189 - DNA, 21 bp, Homo sapiens
aagaatagtcataactagatt

SEQ ID NO: 8190 - DNA, 21 bp, Homo sapiens
agaatagtcataactagatta

SEQ ID NO: 8191 - DNA, 21 bp, Homo sapiens
tagtcataactagattaagat

SEQ ID NO: 8192 - DNA, 21 bp, Homo sapiens
taactagattaagatctgtgt

SEQ ID NO: 8193 - DNA, 21 bp, Homo sapiens
actagattaagatctgtgttt

SEQ ID NO: 8194 - DNA, 21 bp, Homo sapiens
ctagattaagatctgtgtttt

SEQ ID NO: 8195 - DNA, 21 bp, Homo sapiens
agattaagatctgtgttttag

SEQ ID NO: 8196 - DNA, 21 bp, Homo sapiens
gatctgtgttttagtttaata

SEQ ID NO: 8197 - DNA, 21 bp, Homo sapiens
atctgtgttttagtttaatag

SEQ ID NO: 8198 - DNA, 21 bp, Homo sapiens
ctgtgttttagtttaatagtt

SEQ ID NO: 8199 - DNA, 21 bp, Homo sapiens
gtgttttagtttaatagtttg

SEQ ID NO: 8200 - DNA, 21 bp, Homo sapiens
tgttttagtttaatagtttga

SEQ ID NO: 8201 - DNA, 21 bp, Homo sapiens
ctgtttgggataatgataggt

SEQ ID NO: 8202 - DNA, 21 bp, Homo sapiens
gtttgggataatgataggtaa

SEQ ID NO: 8203 - DNA, 21 bp, Homo sapiens
tgggataatgataggtaattt

SEQ ID NO: 8204 - DNA, 21 bp, Homo sapiens
gggataatgataggtaattta

SEQ ID NO: 8205 - DNA, 21 bp, Homo sapiens
ataatgataggtaatttagat

SEQ ID NO: 8206 - DNA, 21 bp, Homo sapiens
taatgataggtaatttagatg

SEQ ID NO: 8207 - DNA, 21 bp, Homo sapiens
ataggtaatttagatgaattt

SEQ ID NO: 8208 - DNA, 21 bp, Homo sapiens
aggtaatttagatgaatttag

SEQ ID NO: 8209 - DNA, 21 bp, Homo sapiens
ttagatgaatttaggggaaaa

SEQ ID NO: 8210 - DNA, 21 bp, Homo sapiens
tagatgaatttaggggaaaaa

SEQ ID NO: 8211 - DNA, 21 bp, Homo sapiens
aggggaaaaaaaagttatctg

SEQ ID NO: 8212 - DNA, 21 bp, Homo sapiens
ggggaaaaaaaagttatctgc

SEQ ID NO: 8213 - DNA, 21 bp, Homo sapiens
aaaaaaagttatctgcagata

SEQ ID NO: 8214 - DNA, 21 bp, Homo sapiens
ctgtcttgtgttttcatgttg

SEQ ID NO: 8215 - DNA, 21 bp, Homo sapiens
tgtcttgtgttttcatgttga

SEQ ID NO: 8216 - DNA, 21 bp, Homo sapiens
gtcttgtgttttcatgttgaa

SEQ ID NO: 8217 - DNA, 21 bp, Homo sapiens
ttcatgttgaaaatacttttg

SEQ ID NO: 8218 - DNA, 21 bp, Homo sapiens
tcatgttgaaaatacttttgc

SEQ ID NO: 8219 - DNA, 21 bp, Homo sapiens
catgttgaaaatacttttgca

SEQ ID NO: 8220 - DNA, 21 bp, Homo sapiens
atgttgaaaatacttttgcat

SEQ ID NO: 8221 - DNA, 21 bp, Homo sapiens
tacttttgcatttttcctttg

SEQ ID NO: 8222 - DNA, 21 bp, Homo sapiens
tttgagtgccaatttcttact

SEQ ID NO: 8223 - DNA, 21 bp, Homo sapiens
gtgccaatttcttactagtac

SEQ ID NO: 8224 - DNA, 21 bp, Homo sapiens
tgccaatttcttactagtact

SEQ ID NO: 8225 - DNA, 21 bp, Homo sapiens
cttactagtactatttcttaa

SEQ ID NO: 8226 - DNA, 21 bp, Homo sapiens
ttactagtactatttcttaat

SEQ ID NO: 8227 - DNA, 21 bp, Homo sapiens
agtactatttcttaatgtaac

SEQ ID NO: 8228 - DNA, 21 bp, Homo sapiens
gtactatttcttaatgtaaca

SEQ ID NO: 8229 - DNA, 21 bp, Homo sapiens
tactatttcttaatgtaacat

SEQ ID NO: 8230 - DNA, 21 bp, Homo sapiens
tcttaatgtaacatgtttacc

SEQ ID NO: 8231 - DNA, 21 bp, Homo sapiens
tacctggaatgtattttaact

SEQ ID NO: 8232 - DNA, 21 bp, Homo sapiens
cctggaatgtattttaactat

SEQ ID NO: 8233 - DNA, 21 bp, Homo sapiens
ctggaatgtattttaactatt

SEQ ID NO: 8234 - DNA, 21 bp, Homo sapiens
tggaatgtattttaactattt

SEQ ID NO: 8235 - DNA, 21 bp, Homo sapiens
ggaatgtattttaactatttt

SEQ ID NO: 8236 - DNA, 21 bp, Homo sapiens
aatgtattttaactatttttg

SEQ ID NO: 8237 - DNA, 21 bp, Homo sapiens
tgtattttaactatttttgta

SEQ ID NO: 8238 - DNA, 21 bp, Homo sapiens
gtattttaactatttttgtat

SEQ ID NO: 8239 - DNA, 21 bp, Homo sapiens
tattttaactatttttgtata

SEQ ID NO: 8240 - DNA, 21 bp, Homo sapiens
actatttttgtatagtgtaaa

SEQ ID NO: 8241 - DNA, 21 bp, Homo sapiens
ctatttttgtatagtgtaaac

SEQ ID NO: 8242 - DNA, 21 bp, Homo sapiens
tatttttgtatagtgtaaact

SEQ ID NO: 8243 - DNA, 21 bp, Homo sapiens
taaactgaaacatgcacattt

SEQ ID NO: 8244 - DNA, 21 bp, Homo sapiens
gaaacatgcacattttgtaca

SEQ ID NO: 8245 - DNA, 21 bp, Homo sapiens
gatccagttgttttccatcat

SEQ ID NO: 8246 - DNA, 21 bp, Homo sapiens
tccagttgttttccatcattt

SEQ ID NO: 8247 - DNA, 21 bp, Homo sapiens
gaatgttggtcatatcaaaca

SEQ ID NO: 8248 - DNA, 21 bp, Homo sapiens
aatgttggtcatatcaaacat

SEQ ID NO: 8249 - DNA, 21 bp, Homo sapiens
atgttggtcatatcaaacatt

SEQ ID NO: 8250 - DNA, 21 bp, Homo sapiens
tggtcatatcaaacattaaaa

SEQ ID NO: 8251 - DNA, 21 bp, Homo sapiens
taaaaatgaccactcttttaa

SEQ ID NO: 8252 - DNA, 21 bp, Homo sapiens
aaaaatgaccactcttttaat

SEQ ID NO: 8253 - DNA, 21 bp, Homo sapiens
cactcttttaattgaaattaa

SEQ ID NO: 8254 - DNA, 21 bp, Homo sapiens
actcttttaattgaaattaac

SEQ ID NO: 8255 - DNA, 21 bp, Homo sapiens
tcttttaattgaaattaactt

SEQ ID NO: 8256 - DNA, 21 bp, Homo sapiens
ttttaattgaaattaactttt

SEQ ID NO: 8257 - DNA, 21 bp, Homo sapiens
tttaattgaaattaactttta

SEQ ID NO: 8258 - DNA, 21 bp, Homo sapiens
ttaattgaaattaacttttaa

SEQ ID NO: 8259 - DNA, 21 bp, Homo sapiens
taattgaaattaacttttaaa

SEQ ID NO: 8260 - DNA, 21 bp, Homo sapiens
aattgaaattaacttttaaat

SEQ ID NO: 8261 - DNA, 21 bp, Homo sapiens
attgaaattaacttttaaatg

SEQ ID NO: 8262 - DNA, 21 bp, Homo sapiens
gaaattaacttttaaatgttt

SEQ ID NO: 8263 - DNA, 21 bp, Homo sapiens
ttaacttttaaatgtttatag

SEQ ID NO: 8264 - DNA, 21 bp, Homo sapiens
cttttaaatgtttataggagt

SEQ ID NO: 8265 - DNA, 21 bp, Homo sapiens
ttttaaatgtttataggagta

SEQ ID NO: 8266 - DNA, 21 bp, Homo sapiens
gtgctgtgaagtgatctaaaa

SEQ ID NO: 8267 - DNA, 21 bp, Homo sapiens
gctgtgaagtgatctaaaatt

SEQ ID NO: 8268 - DNA, 21 bp, Homo sapiens
ctgtgaagtgatctaaaattt

SEQ ID NO: 8269 - DNA, 21 bp, Homo sapiens
tgtgaagtgatctaaaatttg

SEQ ID NO: 8270 - DNA, 21 bp, Homo sapiens
gtgaagtgatctaaaatttgt

SEQ ID NO: 8271 - DNA, 21 bp, Homo sapiens
tgaagtgatctaaaatttgta

SEQ ID NO: 8272 - DNA, 21 bp, Homo sapiens
gaagtgatctaaaatttgtaa

SEQ ID NO: 8273 - DNA, 21 bp, Homo sapiens
tgatctaaaatttgtaatatt

SEQ ID NO: 8274 - DNA, 21 bp, Homo sapiens
gatctaaaatttgtaatattt

SEQ ID NO: 8275 - DNA, 21 bp, Homo sapiens
taaaatttgtaatatttttgt

SEQ ID NO: 8276 - DNA, 21 bp, Homo sapiens
aaaatttgtaatatttttgtc

SEQ ID NO: 8277 - DNA, 21 bp, Homo sapiens
aaatttgtaatatttttgtca

SEQ ID NO: 8278 - DNA, 21 bp, Homo sapiens
ttgtaatatttttgtcatgaa

SEQ ID NO: 8279 - DNA, 21 bp, Homo sapiens
tgtaatatttttgtcatgaac

SEQ ID NO: 8280 - DNA, 21 bp, Homo sapiens
tgaactgtactactcctaatt

SEQ ID NO: 8281 - DNA, 21 bp, Homo sapiens
gaactgtactactcctaatta

SEQ ID NO: 8282 - DNA, 21 bp, Homo sapiens
actcctaattattgtaatgta

SEQ ID NO: 8283 - DNA, 21 bp, Homo sapiens
ctcctaattattgtaatgtaa

SEQ ID NO: 8284 - DNA, 21 bp, Homo sapiens
cctaattattgtaatgtaata

SEQ ID NO: 8285 - DNA, 21 bp, Homo sapiens
taattattgtaatgtaataaa

SEQ ID NO: 8286 - DNA, 21 bp, Homo sapiens
aattattgtaatgtaataaaa

SEQ ID NO: 8287 - DNA, 21 bp, Homo sapiens
ttattgtaatgtaataaaaat

SEQ ID NO: 8288 - DNA, 21 bp, Homo sapiens
tattgtaatgtaataaaaata

SEQ ID NO: 8289 - DNA, 21 bp, Homo sapiens
gtaatgtaataaaaatagtta

SEQ ID NO: 8290 - DNA, 21 bp, Homo sapiens
taatgtaataaaaatagttac

SEQ ID NO: 8291 - DNA, 21 bp, Homo sapiens
aatgtaataaaaatagttaca

SEQ ID NO: 8292 - DNA, 21 bp, Homo sapiens
aaaaatagttacagtgacaaa

SEQ ID NO: 8293 - DNA, 21 bp, Homo sapiens
aaaatagttacagtgacaaaa

SEQ ID NO: 8294 - DNA, 21 bp, Homo sapiens
aatagttacagtgacaaaaaa

SEQ ID NO: 8295 - DNA, 21 bp, Homo sapiens
gagaggcctgctgaaaatgac

SEQ ID NO: 8296 - DNA, 21 bp, Homo sapiens
agaggcctgctgaaaatgact

SEQ ID NO: 8297 - DNA, 21 bp, Homo sapiens
gaggcctgctgaaaatgactg

SEQ ID NO: 8298 - DNA, 21 bp, Homo sapiens
aggcctgctgaaaatgactga

SEQ ID NO: 8299 - DNA, 21 bp, Homo sapiens
tagttggagctggtggcgtag

SEQ ID NO: 8300 - DNA, 21 bp, Homo sapiens
agttggagctggtggcgtagg

SEQ ID NO: 8301 - DNA, 21 bp, Homo sapiens
gttggagctggtggcgtaggc

SEQ ID NO: 8302 - DNA, 21 bp, Homo sapiens
ttggagctggtggcgtaggca

SEQ ID NO: 8303 - DNA, 21 bp, Homo sapiens
tggagctggtggcgtaggcaa

SEQ ID NO: 8304 - DNA, 21 bp, Homo sapiens
ggagctggtggcgtaggcaag

SEQ ID NO: 8305 - DNA, 21 bp, Homo sapiens
gagctggtggcgtaggcaaga

SEQ ID NO: 8306 - DNA, 21 bp, Homo sapiens
gatacagctaattcagaatca

SEQ ID NO: 8307 - DNA, 21 bp, Homo sapiens
agtaattgatggagaaacctg

SEQ ID NO: 8308 - DNA, 21 bp, Homo sapiens
gtaattgatggagaaacctgt

SEQ ID NO: 8309 - DNA, 21 bp, Homo sapiens
ttgatggagaaacctgtctct

SEQ ID NO: 8310 - DNA, 21 bp, Homo sapiens
aacctgtctcttggatattct

SEQ ID NO: 8311 - DNA, 21 bp, Homo sapiens
cctgtctcttggatattctcg

SEQ ID NO: 8312 - DNA, 21 bp, Homo sapiens
ctgtctcttggatattctcga

SEQ ID NO: 8313 - DNA, 21 bp, Homo sapiens
tgtctcttggatattctcgac

SEQ ID NO: 8314 - DNA, 21 bp, Homo sapiens
gtctcttggatattctcgaca

SEQ ID NO: 8315 - DNA, 21 bp, Homo sapiens
tctcttggatattctcgacac

SEQ ID NO: 8316 - DNA, 21 bp, Homo sapiens
ctcttggatattctcgacaca

SEQ ID NO: 8317 - DNA, 21 bp, Homo sapiens
tcttggatattctcgacacag

SEQ ID NO: 8318 - DNA, 21 bp, Homo sapiens
cacagcaggtcaagaggagta

SEQ ID NO: 8319 - DNA, 21 bp, Homo sapiens
acagcaggtcaagaggagtac

SEQ ID NO: 8320 - DNA, 21 bp, Homo sapiens
cagcaggtcaagaggagtaca

SEQ ID NO: 8321 - DNA, 21 bp, Homo sapiens
agaggagtacagtgcaatgag

SEQ ID NO: 8322 - DNA, 21 bp, Homo sapiens
gaggagtacagtgcaatgagg

SEQ ID NO: 8323 - DNA, 21 bp, Homo sapiens
aggagtacagtgcaatgaggg

SEQ ID NO: 8324 - DNA, 21 bp, Homo sapiens
ggagtacagtgcaatgaggga

SEQ ID NO: 8325 - DNA, 21 bp, Homo sapiens
gagtacagtgcaatgagggac

SEQ ID NO: 8326 - DNA, 21 bp, Homo sapiens
agtacagtgcaatgagggacc

SEQ ID NO: 8327 - DNA, 21 bp, Homo sapiens
gtacagtgcaatgagggacca

SEQ ID NO: 8328 - DNA, 21 bp, Homo sapiens
tacagtgcaatgagggaccag

SEQ ID NO: 8329 - DNA, 21 bp, Homo sapiens
acagtgcaatgagggaccagt

SEQ ID NO: 8330 - DNA, 21 bp, Homo sapiens
gtgtatttgccataaataata

SEQ ID NO: 8331 - DNA, 21 bp, Homo sapiens
tgtatttgccataaataatac

SEQ ID NO: 8332 - DNA, 21 bp, Homo sapiens
gtatttgccataaataatact

SEQ ID NO: 8333 - DNA, 21 bp, Homo sapiens
tatttgccataaataatacta

SEQ ID NO: 8334 - DNA, 21 bp, Homo sapiens
atttgccataaataatactaa

SEQ ID NO: 8335 - DNA, 21 bp, Homo sapiens
tttgccataaataatactaaa

SEQ ID NO: 8336 - DNA, 21 bp, Homo sapiens
ttgccataaataatactaaat

SEQ ID NO: 8337 - DNA, 21 bp, Homo sapiens
taatactaaatcatttgaaga

SEQ ID NO: 8338 - DNA, 21 bp, Homo sapiens
aatactaaatcatttgaagat

SEQ ID NO: 8339 - DNA, 21 bp, Homo sapiens
atactaaatcatttgaagata

SEQ ID NO: 8340 - DNA, 21 bp, Homo sapiens
tactaaatcatttgaagatat

SEQ ID NO: 8341 - DNA, 21 bp, Homo sapiens
actaaatcatttgaagatatt

SEQ ID NO: 8342 - DNA, 21 bp, Homo sapiens
ctaaatcatttgaagatattc

SEQ ID NO: 8343 - DNA, 21 bp, Homo sapiens
taaatcatttgaagatattca

SEQ ID NO: 8344 - DNA, 21 bp, Homo sapiens
aaatcatttgaagatattcac

SEQ ID NO: 8345 - DNA, 21 bp, Homo sapiens
aatcatttgaagatattcacc

SEQ ID NO: 8346 - DNA, 21 bp, Homo sapiens
agatattcaccattatagaga

SEQ ID NO: 8347 - DNA, 21 bp, Homo sapiens
gatattcaccattatagagaa

SEQ ID NO: 8348 - DNA, 21 bp, Homo sapiens
atattcaccattatagagaac

SEQ ID NO: 8349 - DNA, 21 bp, Homo sapiens
tattcaccattatagagaaca

SEQ ID NO: 8350 - DNA, 21 bp, Homo sapiens
attcaccattatagagaacaa

SEQ ID NO: 8351 - DNA, 21 bp, Homo sapiens
ttcaccattatagagaacaaa

SEQ ID NO: 8352 - DNA, 21 bp, Homo sapiens
tcaccattatagagaacaaat

SEQ ID NO: 8353 - DNA, 21 bp, Homo sapiens
caccattatagagaacaaatt

SEQ ID NO: 8354 - DNA, 21 bp, Homo sapiens
accattatagagaacaaatta

SEQ ID NO: 8355 - DNA, 21 bp, Homo sapiens
acctatggtcctagtaggaaa

SEQ ID NO: 8356 - DNA, 21 bp, Homo sapiens
aatgtgatttgccttctagaa

SEQ ID NO: 8357 - DNA, 21 bp, Homo sapiens
atgtgatttgccttctagaac

SEQ ID NO: 8358 - DNA, 21 bp, Homo sapiens
gtgatttgccttctagaacag

SEQ ID NO: 8359 - DNA, 21 bp, Homo sapiens
aagttatggaattccttttat

SEQ ID NO: 8360 - DNA, 21 bp, Homo sapiens
agttatggaattccttttatt

SEQ ID NO: 8361 - DNA, 21 bp, Homo sapiens
gttatggaattccttttattg

SEQ ID NO: 8362 - DNA, 21 bp, Homo sapiens
atgatgccttctatacattag

SEQ ID NO: 8363 - DNA, 21 bp, Homo sapiens
tgatgccttctatacattagt

SEQ ID NO: 8364 - DNA, 21 bp, Homo sapiens
ttcgagaaattcgaaaacata

SEQ ID NO: 8365 - DNA, 21 bp, Homo sapiens
tcgaaaacataaagaaaagat

SEQ ID NO: 8366 - DNA, 21 bp, Homo sapiens
cgaaaacataaagaaaagatg

SEQ ID NO: 8367 - DNA, 21 bp, Homo sapiens
gaaaacataaagaaaagatga

SEQ ID NO: 8368 - DNA, 21 bp, Homo sapiens
aaaacataaagaaaagatgag

SEQ ID NO: 8369 - DNA, 21 bp, Homo sapiens
aaacataaagaaaagatgagc

SEQ ID NO: 8370 - DNA, 21 bp, Homo sapiens
aacataaagaaaagatgagca

SEQ ID NO: 8371 - DNA, 21 bp, Homo sapiens
acataaagaaaagatgagcaa

SEQ ID NO: 8372 - DNA, 21 bp, Homo sapiens
cataaagaaaagatgagcaaa

SEQ ID NO: 8373 - DNA, 21 bp, Homo sapiens
ataaagaaaagatgagcaaag

SEQ ID NO: 8374 - DNA, 21 bp, Homo sapiens
acaagtggtaatttttgtaca

SEQ ID NO: 8375 - DNA, 21 bp, Homo sapiens
caagtggtaatttttgtacat

SEQ ID NO: 8376 - DNA, 21 bp, Homo sapiens
ttttgtacattacactaaatt

SEQ ID NO: 8377 - DNA, 21 bp, Homo sapiens
tttgtacattacactaaatta

SEQ ID NO: 8378 - DNA, 21 bp, Homo sapiens
ttgtacattacactaaattat

SEQ ID NO: 8379 - DNA, 21 bp, Homo sapiens
tgtacattacactaaattatt

SEQ ID NO: 8380 - DNA, 21 bp, Homo sapiens
gtacattacactaaattatta

SEQ ID NO: 8381 - DNA, 21 bp, Homo sapiens
tacattacactaaattattag

SEQ ID NO: 8382 - DNA, 21 bp, Homo sapiens
acattacactaaattattagc

SEQ ID NO: 8383 - DNA, 21 bp, Homo sapiens
cattacactaaattattagca

SEQ ID NO: 8384 - DNA, 21 bp, Homo sapiens
attacactaaattattagcat

SEQ ID NO: 8385 - DNA, 21 bp, Homo sapiens
attattagcatttgttttagc

SEQ ID NO: 8386 - DNA, 21 bp, Homo sapiens
ttattagcatttgttttagca

SEQ ID NO: 8387 - DNA, 21 bp, Homo sapiens
tattagcatttgttttagcat

SEQ ID NO: 8388 - DNA, 21 bp, Homo sapiens
attagcatttgttttagcatt

SEQ ID NO: 8389 - DNA, 21 bp, Homo sapiens
ttagcatttgttttagcatta

SEQ ID NO: 8390 - DNA, 21 bp, Homo sapiens
tagcatttgttttagcattac

SEQ ID NO: 8391 - DNA, 21 bp, Homo sapiens
agcatttgttttagcattacc

SEQ ID NO: 8392 - DNA, 21 bp, Homo sapiens
gcatttgttttagcattacct

SEQ ID NO: 8393 - DNA, 21 bp, Homo sapiens
catttgttttagcattaccta

SEQ ID NO: 8394 - DNA, 21 bp, Homo sapiens
tgcttattttaaaatgacagt

SEQ ID NO: 8395 - DNA, 21 bp, Homo sapiens
cttattttaaaatgacagtgg

SEQ ID NO: 8396 - DNA, 21 bp, Homo sapiens
cctctaagtgccagtattccc

SEQ ID NO: 8397 - DNA, 21 bp, Homo sapiens
aacaaattaatgaagcttttg

SEQ ID NO: 8398 - DNA, 21 bp, Homo sapiens
acaaattaatgaagcttttga

SEQ ID NO: 8399 - DNA, 21 bp, Homo sapiens
tctgtgttttatctagtcaca

SEQ ID NO: 8400 - DNA, 21 bp, Homo sapiens
ctgtgttttatctagtcacat

SEQ ID NO: 8401 - DNA, 21 bp, Homo sapiens
tgttttatctagtcacataaa

SEQ ID NO: 8402 - DNA, 21 bp, Homo sapiens
cataaatggattaattactaa

SEQ ID NO: 8403 - DNA, 21 bp, Homo sapiens
ataaatggattaattactaat

SEQ ID NO: 8404 - DNA, 21 bp, Homo sapiens
taattggtttttactgaaaca

SEQ ID NO: 8405 - DNA, 21 bp, Homo sapiens
gccatttccttttcacattag

SEQ ID NO: 8406 - DNA, 21 bp, Homo sapiens
tccttttcacattagataaat

SEQ ID NO: 8407 - DNA, 21 bp, Homo sapiens
cacattagataaattactata

SEQ ID NO: 8408 - DNA, 21 bp, Homo sapiens
acattagataaattactataa

SEQ ID NO: 8409 - DNA, 21 bp, Homo sapiens
cattagataaattactataaa

SEQ ID NO: 8410 - DNA, 21 bp, Homo sapiens
gttaaggcagacccagtatga

SEQ ID NO: 8411 - DNA, 21 bp, Homo sapiens
ttaaggcagacccagtatgaa

SEQ ID NO: 8412 - DNA, 21 bp, Homo sapiens
taaggcagacccagtatgaaa

SEQ ID NO: 8413 - DNA, 21 bp, Homo sapiens
aaggcagacccagtatgaaat

SEQ ID NO: 8414 - DNA, 21 bp, Homo sapiens
agtatgaaatggggattatta

SEQ ID NO: 8415 - DNA, 21 bp, Homo sapiens
tggggattattatagcaacca

SEQ ID NO: 8416 - DNA, 21 bp, Homo sapiens
tggggctatatttacatgcta

SEQ ID NO: 8417 - DNA, 21 bp, Homo sapiens
ggggctatatttacatgctac

SEQ ID NO: 8418 - DNA, 21 bp, Homo sapiens
gggctatatttacatgctact

SEQ ID NO: 8419 - DNA, 21 bp, Homo sapiens
ggctatatttacatgctacta

SEQ ID NO: 8420 - DNA, 21 bp, Homo sapiens
gctatatttacatgctactaa

SEQ ID NO: 8421 - DNA, 21 bp, Homo sapiens
ctatatttacatgctactaaa

SEQ ID NO: 8422 - DNA, 21 bp, Homo sapiens
tatatttacatgctactaaat

SEQ ID NO: 8423 - DNA, 21 bp, Homo sapiens
atatttacatgctactaaatt

SEQ ID NO: 8424 - DNA, 21 bp, Homo sapiens
tatttacatgctactaaattt

SEQ ID NO: 8425 - DNA, 21 bp, Homo sapiens
atttacatgctactaaatttt

SEQ ID NO: 8426 - DNA, 21 bp, Homo sapiens
tttacatgctactaaattttt

SEQ ID NO: 8427 - DNA, 21 bp, Homo sapiens
ctctttcatagtataacttta

SEQ ID NO: 8428 - DNA, 21 bp, Homo sapiens
tcatagtataactttaaatct

SEQ ID NO: 8429 - DNA, 21 bp, Homo sapiens
catagtataactttaaatctt

SEQ ID NO: 8430 - DNA, 21 bp, Homo sapiens
tttaaatcttttcttcaactt

SEQ ID NO: 8431 - DNA, 21 bp, Homo sapiens
ttaaatcttttcttcaacttg

SEQ ID NO: 8432 - DNA, 21 bp, Homo sapiens
aacttgagtctttgaagatag

SEQ ID NO: 8433 - DNA, 21 bp, Homo sapiens
cttgagtctttgaagatagtt

SEQ ID NO: 8434 - DNA, 21 bp, Homo sapiens
ttgagtctttgaagatagttt

SEQ ID NO: 8435 - DNA, 21 bp, Homo sapiens
aagatagttttaattctgctt

SEQ ID NO: 8436 - DNA, 21 bp, Homo sapiens
agatagttttaattctgcttg

SEQ ID NO: 8437 - DNA, 21 bp, Homo sapiens
gatagttttaattctgcttgt

SEQ ID NO: 8438 - DNA, 21 bp, Homo sapiens
tgcttgtgacattaaaagatt

SEQ ID NO: 8439 - DNA, 21 bp, Homo sapiens
aatattaactcaaaagttgag

SEQ ID NO: 8440 - DNA, 21 bp, Homo sapiens
ggtgtgccaagacattaattt

SEQ ID NO: 8441 - DNA, 21 bp, Homo sapiens
actggttaaattaacattgca

SEQ ID NO: 8442 - DNA, 21 bp, Homo sapiens
ctggttaaattaacattgcat

SEQ ID NO: 8443 - DNA, 21 bp, Homo sapiens
tggttaaattaacattgcata

SEQ ID NO: 8444 - DNA, 21 bp, Homo sapiens
acattgcataaacacttttca

SEQ ID NO: 8445 - DNA, 21 bp, Homo sapiens
tcaagtctgatccatatttaa

SEQ ID NO: 8446 - DNA, 21 bp, Homo sapiens
tttaaaataaatgaagtgaga

SEQ ID NO: 8447 - DNA, 21 bp, Homo sapiens
ttaaaataaatgaagtgagat

SEQ ID NO: 8448 - DNA, 21 bp, Homo sapiens
tcaagctcagcacaatctgta

SEQ ID NO: 8449 - DNA, 21 bp, Homo sapiens
caagctcagcacaatctgtaa

SEQ ID NO: 8450 - DNA, 21 bp, Homo sapiens
gcataactgtgattcttttag

SEQ ID NO: 8451 - DNA, 21 bp, Homo sapiens
actgtgattcttttaggacaa

SEQ ID NO: 8452 - DNA, 21 bp, Homo sapiens
ctgtgattcttttaggacaat

SEQ ID NO: 8453 - DNA, 21 bp, Homo sapiens
ggtgtatgtcagatattcata

SEQ ID NO: 8454 - DNA, 21 bp, Homo sapiens
gtgtatgtcagatattcatat

SEQ ID NO: 8455 - DNA, 21 bp, Homo sapiens
caaatgtgtaatattccagtt

SEQ ID NO: 8456 - DNA, 21 bp, Homo sapiens
cacactgcataggaatttaga

SEQ ID NO: 8457 - DNA, 21 bp, Homo sapiens
gtcaccattgcacaattttgt

SEQ ID NO: 8458 - DNA, 21 bp, Homo sapiens
tcaccattgcacaattttgtc

SEQ ID NO: 8459 - DNA, 21 bp, Homo sapiens
caccattgcacaattttgtcc

SEQ ID NO: 8460 - DNA, 21 bp, Homo sapiens
accattgcacaattttgtcct

SEQ ID NO: 8461 - DNA, 21 bp, Homo sapiens
ccattgcacaattttgtccta

SEQ ID NO: 8462 - DNA, 21 bp, Homo sapiens
cattgcacaattttgtcctaa

SEQ ID NO: 8463 - DNA, 21 bp, Homo sapiens
gatagcatgaattctgcattg

SEQ ID NO: 8464 - DNA, 21 bp, Homo sapiens
atagcatgaattctgcattga

SEQ ID NO: 8465 - DNA, 21 bp, Homo sapiens
agtttgaagtgcctgtttggg

SEQ ID NO: 8466 - DNA, 21 bp, Homo sapiens
gtttgaagtgcctgtttggga

SEQ ID NO: 8467 - DNA, 21 bp, Homo sapiens
tttgaagtgcctgtttgggat

SEQ ID NO: 8468 - DNA, 21 bp, Homo sapiens
cctttgagtgccaatttctta

SEQ ID NO: 8469 - DNA, 21 bp, Homo sapiens
ctttgagtgccaatttcttac

SEQ ID NO: 8470 - DNA, 21 bp, Homo sapiens
tttgagtgccaatttcttact

SEQ ID NO: 8471 - DNA, 21 bp, Homo sapiens
ttgagtgccaatttcttacta

SEQ ID NO: 8472 - DNA, 21 bp, Homo sapiens
tgagtgccaatttcttactag

SEQ ID NO: 8473 - DNA, 21 bp, Homo sapiens
gagtgccaatttcttactagt

SEQ ID NO: 8474 - DNA, 21 bp, Homo sapiens
gaatgtattttaactattttt

SEQ ID NO: 8475 - DNA, 21 bp, Homo sapiens
aatgtattttaactatttttg

SEQ ID NO: 8476 - DNA, 21 bp, Homo sapiens
taactatttttgtatagtgta

SEQ ID NO: 8477 - DNA, 21 bp, Homo sapiens
aactatttttgtatagtgtaa

SEQ ID NO: 8478 - DNA, 21 bp, Homo sapiens
actatttttgtatagtgtaaa

SEQ ID NO: 8479 - DNA, 21 bp, Homo sapiens
ctatttttgtatagtgtaaac

SEQ ID NO: 8480 - DNA, 21 bp, Homo sapiens
tatttttgtatagtgtaaact

SEQ ID NO: 8481 - DNA, 21 bp, Homo sapiens
atttttgtatagtgtaaactg

SEQ ID NO: 8482 - DNA, 21 bp, Homo sapiens
gaaacatgcacattttgtaca

SEQ ID NO: 8483 - DNA, 21 bp, Homo sapiens
aaacatgcacattttgtacat

SEQ ID NO: 8484 - DNA, 21 bp, Homo sapiens
catgcacattttgtacattgt

SEQ ID NO: 8485 - DNA, 21 bp, Homo sapiens
atgcacattttgtacattgtg

SEQ ID NO: 8486 - DNA, 21 bp, Homo sapiens
tgcacattttgtacattgtgc

SEQ ID NO: 8487 - DNA, 21 bp, Homo sapiens
gcacattttgtacattgtgct

SEQ ID NO: 8488 - DNA, 21 bp, Homo sapiens
cacattttgtacattgtgctt

SEQ ID NO: 8489 - DNA, 21 bp, Homo sapiens
acattttgtacattgtgcttt

SEQ ID NO: 8490 - DNA, 21 bp, Homo sapiens
cattttgtacattgtgctttc

SEQ ID NO: 8491 - DNA, 21 bp, Homo sapiens
tgtgggacatatgcagtgtga

SEQ ID NO: 8492 - DNA, 21 bp, Homo sapiens
gtgggacatatgcagtgtgat

SEQ ID NO: 8493 - DNA, 21 bp, Homo sapiens
tgggacatatgcagtgtgatc

SEQ ID NO: 8494 - DNA, 21 bp, Homo sapiens
gggacatatgcagtgtgatcc

SEQ ID NO: 8495 - DNA, 21 bp, Homo sapiens
ggacatatgcagtgtgatcca

SEQ ID NO: 8496 - DNA, 21 bp, Homo sapiens
gacatatgcagtgtgatccag

SEQ ID NO: 8497 - DNA, 21 bp, Homo sapiens
acatatgcagtgtgatccagt

SEQ ID NO: 8498 - DNA, 21 bp, Homo sapiens
catatgcagtgtgatccagtt

SEQ ID NO: 8499 - DNA, 21 bp, Homo sapiens
atatgcagtgtgatccagttg

SEQ ID NO: 8500 - DNA, 21 bp, Homo sapiens
gcagtgtgatccagttgtttt

SEQ ID NO: 8501 - DNA, 21 bp, Homo sapiens
cagtgtgatccagttgttttc

SEQ ID NO: 8502 - DNA, 21 bp, Homo sapiens
agtgtgatccagttgttttcc

SEQ ID NO: 8503 - DNA, 21 bp, Homo sapiens
gtgtgatccagttgttttcca

SEQ ID NO: 8504 - DNA, 21 bp, Homo sapiens
tgtgatccagttgttttccat

SEQ ID NO: 8505 - DNA, 21 bp, Homo sapiens
gtgatccagttgttttccatc

SEQ ID NO: 8506 - DNA, 21 bp, Homo sapiens
catttggttgcgctgacctag

SEQ ID NO: 8507 - DNA, 21 bp, Homo sapiens
atttggttgcgctgacctagg

SEQ ID NO: 8508 - DNA, 21 bp, Homo sapiens
taggaatgttggtcatatcaa

SEQ ID NO: 8509 - DNA, 21 bp, Homo sapiens
aggaatgttggtcatatcaaa

SEQ ID NO: 8510 - DNA, 21 bp, Homo sapiens
ggaatgttggtcatatcaaac

SEQ ID NO: 8511 - DNA, 21 bp, Homo sapiens
gaatgttggtcatatcaaaca

SEQ ID NO: 8512 - DNA, 21 bp, Homo sapiens
aatgttggtcatatcaaacat

SEQ ID NO: 8513 - DNA, 21 bp, Homo sapiens
atgttggtcatatcaaacatt

SEQ ID NO: 8514 - DNA, 21 bp, Homo sapiens
tgttggtcatatcaaacatta

SEQ ID NO: 8515 - DNA, 21 bp, Homo sapiens
gttggtcatatcaaacattaa

SEQ ID NO: 8516 - DNA, 21 bp, Homo sapiens
ttggtcatatcaaacattaaa

SEQ ID NO: 8517 - DNA, 21 bp, Homo sapiens
tgaaattaacttttaaatgtt

SEQ ID NO: 8518 - DNA, 21 bp, Homo sapiens
gaaattaacttttaaatgttt

SEQ ID NO: 8519 - DNA, 21 bp, Homo sapiens
ttaacttttaaatgtttatag

SEQ ID NO: 8520 - DNA, 21 bp, Homo sapiens
taacttttaaatgtttatagg

SEQ ID NO: 8521 - DNA, 21 bp, Homo sapiens
aacttttaaatgtttatagga

SEQ ID NO: 8522 - DNA, 21 bp, Homo sapiens
acttttaaatgtttataggag

SEQ ID NO: 8523 - DNA, 21 bp, Homo sapiens
cttttaaatgtttataggagt

SEQ ID NO: 8524 - DNA, 21 bp, Homo sapiens
ttttaaatgtttataggagta

SEQ ID NO: 8525 - DNA, 21 bp, Homo sapiens
taaaatttgtaatatttttgt

SEQ ID NO: 8526 - DNA, 21 bp, Homo sapiens
aaaatttgtaatatttttgtc

SEQ ID NO: 8527 - DNA, 21 bp, Homo sapiens
aaatttgtaatatttttgtca

SEQ ID NO: 8528 - DNA, 21 bp, Homo sapiens
aatttgtaatatttttgtcat

SEQ ID NO: 8529 - DNA, 21 bp, Homo sapiens
atttgtaatatttttgtcatg

SEQ ID NO: 8530 - DNA, 21 bp, Homo sapiens
tttgtaatatttttgtcatga

SEQ ID NO: 8531 - DNA, 21 bp, Homo sapiens
ttgtaatatttttgtcatgaa

SEQ ID NO: 8532 - DNA, 21 bp, Homo sapiens
tgtaatatttttgtcatgaac

SEQ ID NO: 8533 - DNA, 21 bp, Homo sapiens
ttattgtaatgtaataaaaat

SEQ ID NO: 8534 - DNA, 21 bp, Homo sapiens
tattgtaatgtaataaaaata

SEQ ID NO: 8535 - DNA, 21 bp, Homo sapiens
attgtaatgtaataaaaatag

SEQ ID NO: 8536 - DNA, 21 bp, Homo sapiens
ttgtaatgtaataaaaatagt

SEQ ID NO: 8537 - DNA, 21 bp, Homo sapiens
tgtaatgtaataaaaatagtt

SEQ ID NO: 8538 - RNA, 21 nt, Artificial Sequence
  Description of Artificial Sequence: Synthetic oligonucleotide
caggucaagaggaguacagug

SEQ ID NO: 8539 - RNA, 21 nt, Artificial Sequence
  Description of Artificial Sequence: Synthetic oligonucleotide
cuguacuccucuugaccugcu

SEQ ID NO: 8540 - RNA, 21 nt, Artificial Sequence
  Description of Artificial Sequence: Synthetic oligonucleotide
agcaggucaagaggaguacag

SEQ ID NO: 8541 - RNA, 21 nt, Artificial Sequence
  Description of Artificial Sequence: Synthetic oligonucleotide
cuguacuccucuugaccugcu

SEQ ID NO: 8542 - RNA, 21 nt, Artificial Sequence
  Description of Artificial Sequence: Synthetic oligonucleotide
agcaggucaagaggaguacua

SEQ ID NO: 8543 - RNA, 21 nt, Artificial Sequence
  Description of Artificial Sequence: Synthetic oligonucleotide
uuagcauuuguuuuagcauua

SEQ ID NO: 8544 - RNA, 21 nt, Artificial Sequence
  Description of Artificial Sequence: Synthetic oligonucleotide
augcuaaaacaaaugcuaaua

SEQ ID NO: 8545 - RNA, 21 nt, Artificial Sequence
  Description of Artificial Sequence: Synthetic oligonucleotide
uauuagcauuuguuuuagcau

SEQ ID NO: 8546 - RNA, 21 nt, Artificial Sequence
  Description of Artificial Sequence: Synthetic oligonucleotide
augcuaaaacaaaugcuaaua

SEQ ID NO: 8547 - RNA, 27 nt, Artificial Sequence
  Description of Artificial Sequence: Synthetic oligonucleotide
uauuagcauuuguuuuagcauuacccc

SEQ ID NO: 8548 - RNA, 21 nt, Artificial Sequence
  Description of Artificial Sequence: Synthetic oligonucleotide
uauuagcauuuguuuuagccc

SEQ ID NO: 8549 - DNA, 25 bp, Artificial Sequence
  Description of Artificial Sequence: Synthetic oligonucleotide
  Description of Combined DNA/RNA Molecule: Synthetic oligonucleotide
caggucaagaggaguacagugcaat

SEQ ID NO: 8550 - DNA, 25 bp, Artificial Sequence
  Description of Artificial Sequence: Synthetic oligonucleotide
  Description of Combined DNA/RNA Molecule: Synthetic oligonucleotide
caggucaugaggaguacagugcaat

I claim:

1. An isolated double stranded nucleic acid (dsNA) comprising first and second nucleic acid strands and a duplex region of at least 25 base pairs, wherein each of said first and second nucleic acid strands comprises RNA and has a length which is at least 25 and at most 35 nucleotides, wherein said second oligonucleotide strand is sufficiently complementary to SEQ ID NO: 161 along at least 19 nucleotides of said second oligonucleotide strand length to reduce KRAS target gene expression when said double stranded nucleic acid is introduced into a mammalian cell.

2. The isolated dsNA of claim 1, wherein starting from the first nucleotide (position 1) at the 3' terminus of the first oligonucleotide strand, position 1, 2 and/or 3 is substituted with a modified nucleotide.

3. The isolated dsNA of claim 2, wherein said modified nucleotide residue of said 3' terminus of said first strand is selected from the group consisting of a deoxyribonucleotide, an acyclonucleotide and a fluorescent molecule.

4. The isolated dsNA of claim 2, wherein position 1 of said 3' terminus of the first oligonucleotide strand is a deoxyribonucleotide.

5. The isolated dsNA of claim 1, wherein said 3' terminus of said first strand and said 5' terminus of said second strand form a blunt end.

6. The isolated dsNA of claim 1, wherein said first strand is 25 nucleotides in length and said second strand is 27 nucleotides in length.

7. The isolated dsNA of claim 1, wherein said second strand comprises SEQ ID NO: 26.

8. The isolated dsNA of claim 1, wherein said first strand comprises SEQ ID NO: 105.

9. The isolated dsNA of claim 1 comprising a first strand sequence comprising SEQ ID NO: 105 and a second strand sequence comprising SEQ ID NO: 26.

10. The isolated dsNA of claim 1, wherein each of said first and said second strands has a length which is at least 26 nucleotides.

11. The isolated dsNA of claim 1, wherein all nucleotides of said 1-5 single-stranded nucleotides at said 3' terminus of said second strand are modified nucleotides.

12. The isolated dsNA of claim 1, wherein one or both of the first and second oligonucleotide strands comprises a 5' phosphate.

13. The isolated dsNA of claim 1, wherein said second oligonucleotide strand, starting from the nucleotide residue of said second strand that is complementary to the 5' terminal nucleotide residue of said first oligonucleotide strand, comprises alternating modified and unmodified nucleotide residues.

14. The isolated dsNA of claim 1, wherein said second oligonucleotide strand comprises a nucleotide residue that forms a mismatch with SEQ ID NO: 161.

15. The isolated dsNA of claim 1, wherein each of said first and said second strands has a length which is at least 26 and at most 30 nucleotides.

16. The isolated dsNA of claim 1, wherein said dsRNA is cleaved endogenously in said cell by Dicer.

17. The isolated dsNA of claim 1, wherein the amount of said isolated double stranded nucleic acid sufficient to reduce expression of the target gene is selected from the group consisting of 1 nanomolar or less, 200 picomolar or less, 100 picomolar or less, 50 picomolar or less, 20 picomolar or less, 10 picomolar or less, 5 picomolar or less, 2, picomolar or less and 1 picomolar or less in the environment of said cell.

18. The isolated dsNA of claim 1, wherein said isolated dsRNA possesses greater potency than an isolated 21 mer siRNA directed to the identical at least 19 nucleotides of SEQ ID NO: 161 in reducing target KRAS gene expression when assayed in vitro in a mammalian cell at an effective concentration in the environment of a cell of 1 nanomolar or less.

19. The isolated dsNA of claim 1, wherein said isolated dsRNA possesses greater potency than an isolated 21 mer siRNA directed to the identical at least 19 nucleotides of SEQ ID NO: 161 in reducing target KRAS gene expression when assayed in vitro in a mammalian cell at an effective concentration in the environment of a cell selected from the group consisting of 200 picomolar or less, 100 picomolar or less, 50 picomolar or less, 20 picomolar or less, 10 picomolar or less, 5 picomolar or less, 2, picomolar or less and 1 picomolar or less in the environment of said cell.

20. The isolated dsNA of claim 1, wherein said isolated dsNA is sufficiently complementary to SEQ ID NO: 161 to reduce KRAS target gene expression by an amount (expressed by %) selected from the group consisting of at least 10%, at least 50%, at least 80-90%, at least 95%, at least 98%, and at least 99% when said double stranded nucleic acid is introduced into a mammalian cell.

21. The isolated dsNA of claim 1, wherein the first and second strands are joined by a chemical linker.

22. The isolated double stranded nucleic acid of claim 1, wherein said 3' terminus of said first strand and said 5' terminus of said second strand are joined by a chemical linker.

23. The isolated double stranded nucleic acid of claim 1, wherein a nucleotide of said second or first strand is substituted with a modified nucleotide that directs the orientation of Dicer cleavage.

24. The isolated double stranded nucleic acid of claim 1 comprising a modified nucleotide selected from the group consisting of a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (3TC), a 2',3'-didehydro-2',3'-dideoxythymidine (d4T), a monophosphate nucleotide of 3'-azido-3'-deoxythymidine (AZT), a 2',3'-dideoxy-3'-thiacytidine (3TC) and a monophosphate nucleotide of 2',3'-didehydro-2',3'-dideoxythymidine (d4T), a 4-thiouracil, a 5-bromouracil, a 5-iodouracil, a 5-(3-aminoallyl)-uracil, a 2'-O-alkyl ribonucleotide, a 2'-O-methyl ribonucleotide, a 2'-amino ribonucleotide, a 2'-fluoro ribonucleotide, and a locked nucleic acid.

25. The isolated double stranded nucleic acid of claim 1 comprising a phosphate backbone modification selected from the group consisting of a phosphonate, a phosphorothioate and a phosphotriester.

26. The isolated double-stranded nucleic acid of claim 1, wherein said second strand of said dsNA comprises 1-5 single-stranded nucleotides at its 3' terminus.

27. The isolated dsNA of claim 26, wherein said nucleotides of said 1-5 single-stranded nucleotides at said 3' terminus of said second strand comprise a modified nucleotide.

28. The isolated dsNA of claim 27, wherein said modified nucleotide of said 1-5 single-stranded nucleotides at said 3' terminus of said second strand is a 2'-O-methyl ribonucleotide.

29. The isolated dsNA of claim 27 wherein said modified nucleotide residues are selected from the group consisting of 2'-O-methyl, 2'-methoxyethoxy, 2'-fluoro, 2'-allyl, 2'-O-[2-(methylamino)-2-oxoethyl], 4'-thio, 4'-CH2-O-2'-bridge, 4'-(CH2)2-O-2'-bridge, 2'-LNA, 2'-amino and 2'-O-(N-methlycarbamate).

30. The isolated dsNA of claim 27 comprising two single-stranded nucleotides at 3' terminus of said second strand, wherein said two single-stranded nucleotides comprise a 2'-O-methyl modified ribonucleotide.

31. The isolated dsNA of claim 26 comprising 1-3 single-stranded nucleotides at said 3' terminus of said second strand.

32. The isolated dsNA of claim 26 comprising 1-2 single-stranded nucleotides at said 3' terminus of said second strand.

33. The isolated double-stranded nucleic acid of claim 1, wherein said second oligonucleotide strand is sufficiently complementary to SEQ ID NO: 6863 along at least 19 nucleotides of said second oligonucleotide strand length to reduce KRAS target gene expression when said double stranded nucleic acid is introduced into a mammalian cell.

34. The isolated double-stranded nucleic acid of claim 1, wherein said second oligonucleotide strand comprises a sequence that is completely complementary to SEQ ID NO: 6863.

35. A mammalian cell containing the isolated dsNA of claim 1.

36. A pharmaceutical composition comprising the isolated dsNA of claim 1 and a pharmaceutically acceptable carrier.

37. A kit comprising the isolated dsNA of claim 1 and instructions for its use.

38. A composition possessing KRAS inhibitory activity consisting essentially of an isolated double stranded ribonucleic acid (dsNA) comprising first and second nucleic acid strands and a duplex region of at least 25 base pairs, wherein said second strand of said dsNA comprises 1-5 single-stranded nucleotides at its 3' terminus, wherein said second oligonucleotide strand is sufficiently complementary to SEQ ID NO: 161 along at least 19 nucleotides of said second oligonucleotide strand length to reduce KRAS target gene expression when said double stranded nucleic acid is introduced into a mammalian cell.

39. A method for reducing expression of a target KRAS gene in a mammalian cell comprising contacting a mammalian cell in vitro with an isolated dsNA of claim 1 in an amount sufficient to reduce expression of a target KRAS gene in said cell.

40. The method of claim 39, wherein target KRAS gene expression is reduced by an amount (expressed by %) selected from the group consisting of at least 10%, at least 50% and at least 80-90%.

41. The method of claim 39, wherein KRAS mRNA levels are reduced by an amount (expressed by %) of at least 90% at least 8 days after said cell is contacted with said dsNA.

42. The method of claim 39, wherein KRAS mRNA levels are reduced by an amount (expressed by %) of at least 70% at least 10 days after said cell is contacted with said dsNA.

43. A method for reducing expression of a target KRAS gene in a mammal comprising administering an isolated dsNA of claim 1 to a mammal in an amount sufficient to reduce expression of a target KRAS gene in the mammal.

44. The method of claim 43, wherein said isolated dsNA is administered at a dosage selected from the group consisting of 1 microgram to 5 milligrams per kilogram of said mammal per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, and 0.1 to 2.5 micrograms per kilogram.

45. The method of claim 43, wherein said isolated dsNA possesses greater potency than an isolated 21 mer siRNA directed to the identical at least 19 nucleotides of SEQ ID NO: 161 in reducing target KRAS gene expression when assayed in vitro in a mammalian cell at an effective concentration in the environment of a cell of 1 nanomolar or less.

46. The method of claim 43, wherein said administering step comprises a mode selected from the group consisting of intravenous injection, intramuscular injection, intraperitoneal injection, infusion, subcutaneous injection, transdermal, aerosol, rectal, vaginal, topical, oral and inhaled delivery.

47. A method for selectively inhibiting the growth of a cell comprising contacting a cell with an amount of an isolated dsNA of claim 1 sufficient to inhibit the growth of the cell.

48. The method of claim 47, wherein said cell is a tumor cell of a subject.

49. The method of claim 47, wherein said cell is a tumor cell in vitro.

50. The method of claim 47, wherein said cell is a human cell.

51. A formulation comprising the isolated dsNA of claim 1, wherein said dsNA is present in an amount effective to reduce target KRAS RNA levels when said dsNA is introduced into a mammalian cell in vitro by an amount (expressed by %) selected from the group consisting of at least 10%, at least 50% and at least 80-90%, and wherein said dsNA possesses greater potency than an isolated 21 mer siRNA directed to the identical at least 19 nucleotides of SEQ ID NO: 161 in reducing target KRAS RNA levels when assayed in vitro in a mammalian cell at an effective concentration in the environment of a cell of 1 nanomolar or less.

52. The formulation of claim 51, wherein said effective amount is selected from the group consisting of 1 nanomolar or less, 200 picomolar or less, 100 picomolar or less, 50 picomolar or less, 20 picomolar or less, 10 picomolar or less, 5 picomolar or less, 2, picomolar or less and 1 picomolar or less in the environment of said cell.

53. A formulation comprising the isolated dsNA of claim 1, wherein said dsNA is present in an amount effective to reduce target RNA levels when said dsNA is introduced into a cell of a mammalian subject by an amount (expressed by %) selected from the group consisting of at least 10%, at least 50% and at least 80-90%, and wherein said dsNA possesses greater potency than an isolated 21 mer siRNA directed to the identical at least 19 nucleotides of SEQ ID NO: 161 in reducing target KRAS RNA levels when assayed in vitro in a mammalian cell at an effective concentration in the environment of a cell of 1 nanomolar or less.

54. The formulation of claim 53, wherein said effective amount is a dosage selected from the group consisting of 1 microgram to 5 milligrams per kilogram of said subject per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, and 0.1 to 2.5 micrograms per kilogram.

55. The method of claim 47, wherein said cell is a pancreatic carcinoma cell.

56. The formulation of claim 51, wherein said formulation comprises a lipid.

57. An isolated double stranded nucleic acid (dsNA) comprising first and second nucleic acid strands, wherein each of said first and second nucleic acid strands comprises RNA, wherein said second oligonucleotide strand is 19 to 35 nucleotides in length and comprises a sequence that is completely complementary to SEQ ID NO: 6863 and wherein said dsNA reduces KRAS target gene expression when said double stranded nucleic acid is introduced into a mammalian cell.

* * * * *